US009629906B2

(12) United States Patent
McVey et al.

(10) Patent No.: US 9,629,906 B2
(45) Date of Patent: Apr. 25, 2017

(54) AFFENADENOVIRUS (GORILLA) OR ADENOVIRAL VECTORS AND METHODS OF USE

(71) Applicant: GenVec, Inc., Gaithersburg, MD (US)

(72) Inventors: Duncan McVey, Derwood, MD (US); Douglas E. Brough, Gaithersburg, MD (US); Jason G. D. Gall, Germantown, MD (US)

(73) Assignee: GenVec, Inc., Gaithersburg, MD (US)

( * ) Notice: Subject to any disclaimer, the term of this patent is extended or adjusted under 35 U.S.C. 154(b) by 0 days.

(21) Appl. No.: 14/349,426

(22) PCT Filed: Oct. 5, 2012

(86) PCT No.: PCT/US2012/058978
§ 371 (c)(1),
(2) Date: Apr. 3, 2014

(87) PCT Pub. No.: WO2013/052811
PCT Pub. Date: Apr. 11, 2013

(65) Prior Publication Data
US 2014/0248308 A1    Sep. 4, 2014

Related U.S. Application Data

(60) Provisional application No. 61/543,652, filed on Oct. 5, 2011.

(51) Int. Cl.
*A61K 39/155* (2006.01)
*C07K 14/005* (2006.01)
*C12N 7/00* (2006.01)
*C12N 15/86* (2006.01)

(52) U.S. Cl.
CPC .......... *A61K 39/155* (2013.01); *C07K 14/005* (2013.01); *C12N 7/00* (2013.01); *C12N 15/86* (2013.01); *C12N 2710/10322* (2013.01); *C12N 2710/10333* (2013.01); *C12N 2710/10343* (2013.01)

(58) Field of Classification Search
CPC ............ A61K 2039/5258; A61K 39/12; C07K 14/005; C12N 15/86; C12N 2710/10021; C12N 2710/10022; C12N 2710/10031; C12N 2710/10034; C12N 2710/10311; C12N 2710/10321; C12N 2710/10322; C12N 2710/10341
See application file for complete search history.

(56) References Cited

U.S. PATENT DOCUMENTS

| | | |
|---|---|---|
| 5,837,511 A | 11/1998 | Falck-Pedersen et al. |
| 5,851,806 A | 12/1998 | Kovesdi et al. |
| 5,994,106 A | 11/1999 | Kovesdi et al. |
| 5,994,128 A | 11/1999 | Fallaux et al. |
| 5,998,205 A | 12/1999 | Hallenbeck et al. |
| 6,033,908 A | 3/2000 | Bout et al. |
| 6,127,175 A | 10/2000 | Vigne et al. |
| 6,225,289 B1 | 5/2001 | Kovesdi et al. |
| 6,482,616 B1 | 11/2002 | Kovesdi et al. |
| 6,514,943 B2 | 2/2003 | Kovesdi et al. |
| 6,551,586 B1 | 4/2003 | Davidson et al. |
| 6,677,156 B2 | 1/2004 | Brough et al. |
| 6,682,929 B2 | 1/2004 | Brough et al. |
| 7,195,896 B2 | 3/2007 | Kovesdi et al. |
| 8,940,290 B2 | 1/2015 | Roy et al. |
| 2003/0165820 A1 | 9/2003 | Day et al. |
| 2004/0136963 A1 | 7/2004 | Wilson et al. |
| 2008/0233650 A1 | 9/2008 | Gall et al. |
| 2011/0223135 A1 | 9/2011 | Roy et al. |
| 2014/0248307 A1* | 9/2014 | Gall et al. .................. 424/199.1 |
| 2014/0248308 A1* | 9/2014 | McVey et al. ............. 424/199.1 |
| 2014/0271711 A1* | 9/2014 | Brough et al. ............. 424/211.1 |
| 2014/0314717 A1* | 10/2014 | Brough et al. ............... 424/93.2 |
| 2015/0140025 A1 | 5/2015 | Wei et al. |
| 2015/0152434 A1 | 6/2015 | Roy et al. |
| 2015/0157700 A1 | 6/2015 | Bruder et al. |

FOREIGN PATENT DOCUMENTS

| | | |
|---|---|---|
| WO | WO 94/28152 A1 | 12/1994 |
| WO | WO 95/02697 A2 | 1/1995 |
| WO | WO 95/16772 A1 | 6/1995 |
| WO | WO 95/34671 A1 | 12/1995 |
| WO | WO 96/22378 A1 | 7/1996 |
| WO | WO 97/00326 A1 | 1/1997 |

(Continued)

OTHER PUBLICATIONS

Roy S, Vandenberghe LH, Kryazhimskiy S, Grant R, Calcedo R, Yuan X, Keough M, Sandhu A, Wang Q, Medina-Jaszek CA, Plotkin JB, Wilson JM. Isolation and characterization of adenoviruses persistently shed from the gastrointestinal tract of non-human primates. PLoS Pathog. Jul. 2009;5(7):e1000503. Epub Jul. 3, 2009.*
Roy S, Calcedo R, Vandenberghe LH, Kryazhimskiy S, Yuan X, Grant R, Keough M, Somanathan S, Wang L, Sandhu A, Wang Q, Medina-Jaszek A, Plotkin JB, Wilson JM. Simian adenovirus 45, complete genome. GenBank Acc. No: FJ025901.1. Dep. Jul. 9, 2009.*
Roy S, Calcedo R, Vandenberghe LH, Kryazhimskiy S, Yuan X, Grant R, Keough M, Somanathan S, Wang L, Sandhu A, Wang Q, Medina-Jaszek A, Plotkin JB, Wilson JM. Simian adenovirus 43, complete genome. GenBank Acc. No: FJ025900. Dep. Jul. 9, 2009.*
Altschul et al., "Basic Local Alignment Search Tool," *J. Molecular Biol.*, 215(3): 403-410 (1990).
Altschul et al., "Gapped BLAST and PSI-BLAST: a new generation of protein database search programs," *Nucleic Acids Res.*, 25(17): 3389-3402 (1997).

(Continued)

*Primary Examiner* — Rachel B Gill
(74) *Attorney, Agent, or Firm* — Leydig, Voit & Mayer, Ltd.

(57) ABSTRACT

The invention provides an adenovirus or adenoviral vector characterized by comprising one or more particular nucleic acid sequences or one or more particular amino acid sequences, or portions thereof, pertaining to, for example, an adenoviral pIX protein, DNA polymerase protein, penton protein, hexon protein, and/or fiber protein.

115 Claims, No Drawings

(56) References Cited

FOREIGN PATENT DOCUMENTS

| WO | WO 97/12986 A2 | 4/1997 |
| WO | WO 97/21826 A2 | 6/1997 |
| WO | WO 00/00628 A1 | 1/2000 |
| WO | WO 00/34444 A2 | 6/2000 |
| WO | WO 03/020879 A2 | 3/2003 |
| WO | WO 03/022311 A1 | 3/2003 |
| WO | WO 2008/011609 A2 | 1/2008 |
| WO | WO 2010/051367 A1 | 5/2010 |
| WO | WO 2010051367 A1 * | 5/2010 |
| WO | WO 2011/057248 A2 | 5/2011 |

OTHER PUBLICATIONS

Bai et al., "Mutations that alter an Arg-Gly-Asp (RGD) sequence in the adenovirus type 2 penton base protein abolish its cell-rounding activity and delay virus reproduction in flat cells," *J. Virol.*, 67(9): 5198-5205 (1993).

Biegert et al., "Sequence context-specific profiles for homology searching," *Proc. Natl. Acad. Sci. USA*, 106(10): 3770-3775 (2009).

Boulanger et al., "Characterization of adenovirus protein IX," *J. Gen. Virol.*, 44(3): 783-800 (1979).

Brough et al., "Activation of transgene expression by early region 4 is responsible for a high level of persistent transgene expression from adenovirus vectors in vivo," *J. Virol.*, 71(12): 9206-9213 (1997).

Cartier et al., "Hematopoietic stem cell gene therapy with a lentiviral vector in X-linked adrenoleukodystrophy," *Science*, 326(5954): 818-823 (2009).

Cavazzana-Calvo et al., "Gene therapy of human severe combined immunodeficiency (SCID)-X1 disease," *Science*, 288(5466): 669-672 (2000).

Chen et al., "Persistence in muscle of an adenoviral vector that lacks all viral genes," *Proc. Natl. Acad. Sci. USA*, 94(5): 1645-1650 (1997).

Chroboczek et al., "The sequence of the genome of adenovirus type 5 and its comparison with the genome of adenovirus type 2," *Virology*, 186(1): 280-285 (1992).

Crawford-Miksza et al., "Analysis of 15 adenovirus hexon proteins reveals the location and structure of seven hypervariable regions containing serotype-specific residues," *J. Virol.*, 70(3): 1836-1844 (1996).

Curiel et al., "High-efficiency gene transfer mediated by adenovirus coupled to DNA-polylysine complexes," *Hum. Gene Ther.*, 3(2): 147-154 (1992).

Devaux et al., "Structure of adenovirus fibre. I. Analysis of crystals of fibre from adenovirus serotypes 2 and 5 by electron microscopy and X-ray crystallography," *J. Molec. Biol.*, 215(4): 567-588 (1990).

Dey et al., "Molecular epidemiology of adenovirus infection among infants and children with acute gastroenteritis in Dhaka City, Bangladesh," *Infect. Genet. Evol.*, 9(4) 518-522 (2009).

Field et al., "Properties of the adenovirus DNA polymerase," *J. Biol. Chem.*, 259(15): 9487-9495 (1984).

Gall et al., "Construction and characterization of hexon-chimeric adenoviruses: specification of adenovirus serotype," *J. Virol.*, 72(12): 10260-10264 (1998).

Genbank Accession No. ABU95388.1, "hexon, partial [Human adenovirus 9]," (Jun. 2009).

Genbank Accession No. EDA88859.1, "hypothetical protein GOS_1918841, partial [marine metagenome]," (Apr. 2007).

Genbank Accession No. FJ025900.1, "Simian adenovirus 43, complete genome," (Mar. 2012).

Genbank Accession No. FJ025901.1, "Simian adenovirus 45, complete genome," (Mar. 2012).

Genbank Accession No. JN163990.1, "Gorilla gorilla beringei adenovirus 6 hexon gene, partial cds," (Dec. 2011).

Ghosh-Choudhury et al., "Protein IX, a minor component of the human adenovirus capsid, is essential for the packaging of full length genomes," *EMBO J.*, 6(6): 1733-1739 (1987).

Ginsberg et al., "A proposed terminology for the adenovirus antigens and virion morphological subunits," *Virology*, 28(4): 782-783 (1966).

Goins et al., "Herpes simplex virus vector-mediated gene delivery for the treatment of lower urinary tract pain," *Gene Ther.*, 16(4): 558-569 (2009).

Graham et al., "Characteristics of a human cell line transformed by DNA from human adenovirus type 5," *J. Gen. Virol.*, 36(1): 59-72 (1977).

Green et al., "Evidence for a repeating cross-beta sheet structure in the adenovirus fibre," *EMBO J.*, 2(8): 1357-1365 (1983).

Hacein-Bey-Abina et al., "A serious adverse event after successful gene therapy for X-linked severe combined immunodeficiency," *N. Engl. J. Med.*, 348(3): 255-256 (2003).

Henry et al., "Characterization of the knob domain of the adenovirus type 5 fiber protein expressed in *Escherichia coli*," *J. Virol.*, 68(8): 5239-5246 (1994).

Horvath et al., "Nonpermissivity of human peripheral blood lymphocytes to adenovirus type 2 infection," *J. Virology*, 62(1): 341-345 (1988).

Jornvall et al., "The adenovirus hexon protein. The primary structure of the polypeptide and its correlation with the hexon gene," *J. Biol. Chem.*, 256(12): 6181-6186 (1981).

Kannan et al., "Structural and functional diversity of the microbial kinome," *PLoS Biol.*, 5(3) E17 (2007).

Kay et al., "Viral vectors for gene therapy: the art of turning infectious agents into vehicles of therapeutics," *Nature Medicine*, 7(1): 33-40 (2001).

Kochanek et al., "High-capacity adenoviral vectors for gene transfer and somatic gene therapy," *Hum. Gene Ther.*, 10(15): 2451-2459 (1999).

Lasaro et al., "New insights on adenovirus as vaccine vectors," *Molecular Therapy*, 17(8): 1333-1339 (2009).

Lutz et al., "The product of the adenovirus intermediate gene IX is a transcriptional activator," *J. Virol.*, 71(7): 5102-5109 (1997).

Mayrhofer et al., "Nonreplicating vaccinia virus vectors expressing the H5 influenza virus hemagglutinin produced in modified Vero cells induce robust protection," *J. Virol.*, 83(10): 5192-5203 (2009).

Mease et al., "Safety, tolerability, and clinical outcomes after intraarticular injection of a recombinant adeno-associated vector containing a tumor necrosis factor antagonist gene: results of a phase ½ Study," *Journal of Rheumatology*, 37(4): 692-703 (2010).

Morsy et al., An adenoviral vector deleted for all viral coding sequences results in enhanced safety and extended expression of a leptin transgene, *Proc. Natl. Acad. Sci. USA*, 95: 7866-7871 (1998).

NCBI reference sequence AP_000218, "E3 12.5K [Human adenovirus 5]," (Dec. 2008).

NCBI reference sequence AP_000224.1, "*Homo sapiens* genomic DNA, chromosome 21q21.2, LL56-APP region, clone:B2017A3, complete sequence," (Nov. 1991).

Neumann et al., "Determination of the nucleotide sequence for the penton-base gene of human adenovirus type 5," *Gene*, 69(1) 153-157 (1988).

Novelli et al., "Deletion analysis of functional domains in baculovirus-expressed adenovirus type 2 fiber," *Virology*, 185(1): 365-376 (1991).

Roberts et al., "Three-dimensional structure of the adenovirus major coat protein hexon," *Science*, 232(4754): 1148-1151 (1986).

Roy et al., "Isolation and Characterization of Adenoviruses Persistently Shed from the Gastrointestinal Tract of Non-Human Primates," *PLOS Pathogens*, 5(7): E1000503, 1-9, (2009).

Rusch et al., "The Sorcerer II Global Ocean Sampling expedition: northwest Atlantic through eastern tropical Pacific," *PLoS Biol.*, 5(3) E77 (2007).

Rux et al., "Structural and phylogenetic analysis of adenovirus hexons by use of high-resolution x-ray crystallographic, molecular modeling, and sequence-based methods," *J. Virol.*, 77(17): 9553-9566 (2003).

Signas et al., Adenovirus 3 Fiber Polypeptide Gene: Implications for the Structure of the Fiber Protein, *J. Virol.*, 53(2): 672-678 (1985).

Silver et al., "Interaction of human adenovirus serotype 2 with human lymphoid cells," *Virology*, 165(2): 377-387 (1988).

(56) References Cited

OTHER PUBLICATIONS

Soding, "Protein homology detection by HMM-HMM comparison," *Bioinformatics*, 21(7): 951-960 (2005).
Stewart et al., "Image reconstruction reveals the complex molecular organization of adenovirus," *Cell*, 67(1): 145-154 (1991).
Stewart et al., "Difference imaging of adenovirus: bridging the resolution gap between X-ray crystallography and electron microscopy," *EMBO J.*, 12(7): 2589-99 (1993).
Thomas et al., "Progress and problems with the use of viral vectors for gene therapy," *Nature Review Genetics*, 4(5): 346-358 (2003).
Van Oostrum et al, "Molecular composition of the adenovirus type 2 virion," *J. Virol.*, 56(2): 439-448 (1985).
Wevers et al., "A novel adenovirus of Western lowland gorillas (Gorilla gorilla gorilla)," *J. Virology*, 7(1): 1-8 (2010).
Wevers et al., "Novel Adenoviruses in Wild Primates: a High Level of Genetic Diversity and Evidence of Zoonotic Transmissions," *J. Virology*, 85(20): 10774-10784, (2011).
Yeh et al., "Human adenovirus type 41 contains two fibers," *Virus Res.*, 33(2): 179-198 (1991).
Yooseph et al., "The Sorcerer II Global Ocean Sampling expedition: expanding the universe of protein families," *PLoS Biol.*, 5(3) E16, (2007).
Aubert et al., "Accumulation of Herpes Simplex Virus Type 1 Early and Leaky-Late Proteins Correlates with Apoptosis Prevention in infected Human Hep-2 Cells," *J. Virol.*, 75(2): 1013-1030 (2001).
Dolan et al., "The genome sequence of herpes simplex virus type 2," *J. Virol.* 72(3): 2010-2021 (1998).
European Patent Office, International Search Report in International Patent Application No. PCT/US/2013/041358 (Dec. 11, 2014).
Genbank Accession No. ABX79578, "UL47 [Human herpesvirus 2]" (Apr. 14, 2009).
Genbank Accession No. CAB06743.1, "Major capsid protein [Human herpesvirus 2]" (Nov. 14, 2006).
Genbank Accession No. EDL20708.1, "mCG1048340," (Jun. 2007).
Genbank Accession No. FJ025901, "Simian adenovirus 45, complete genome," (Jul. 2009).
Genbank Accession No. KC702813.1,"Gorilla beringei beringei adenovirus 7 isolate GC44 hexon gene, complete cds" (Sep. 2013).
Genbank Accession No. KC702815.1, "Gorilla beringei graueri adenovirus 9 isolate GC46 hexon gene, complete cds," (Sep. 2013).
Genbank Accession No. KC702816, "Gorilla beringei beringei adenovirus 7 isolate GC44 DNA polymerase gene, complete cds," (Sep. 2013).
Genbank Accession No. P89442.1, "Major capsid protein" (Nov. 2005).
Genbank Accession No. P89467, "Tegument protien and transactivator of immediate early genes," (Oct. 2006).
Koelle et al., "CD4 T-cell responses to herpes simplex virus type 2 major capsid protein VP5: Comparison with responses to tegument and envelope glycoproteins", *J. Virol.*, 74(23):11422-11425 (2000).
Kohlmann et al., "Protective efficacy and immunogenictiy of an adenoviral vector vaccine encoding the codon-optimized F protein of respiratory syncytial virus," *J Virol.* 83(23): 12601-12610 (2009)
Muller et al., "Herpes simplez virus type 2 tegument proteins contain subdominant T-cell epitopes detectable in BALB/c mice after DNA immunization and infection",*J. Virol.*, 90 (5): 1153-1163 (2009).
Roy et al., "Generation of an adenoviral vaccine vector based on simian adenovirus 21," *Journal of General Virology* 87: 2477-2485 (2006).
Subak-Sharpe et al., "HSV Molecular Biology: General Aspects of Herpes Simplex Virus Molecular Biology", *Virus Genes*, 16(3): 239-251 (1998).

* cited by examiner

US 9,629,906 B2

AFFENADENOVIRUS (GORILLA) OR ADENOVIRAL VECTORS AND METHODS OF USE

CROSS-REFERENCE TO RELATED APPLICATIONS

This patent application claims the benefit of U.S. Provisional Patent Application No. 61/543,652, filed Oct. 5, 2011, which is incorporated by reference.

INCORPORATION-BY-REFERENCE OF MATERIAL SUBMITTED ELECTRONICALLY

Incorporated by reference in its entirety herein is a computer-readable nucleotide/amino acid sequence listing submitted concurrently herewith and identified as follows: One 719,988 Byte ASCII (Text) file named "716440_ST25.txt," created on Mar. 28, 2014.

BACKGROUND OF THE INVENTION

In vivo delivery of proteins in biologically relevant forms and amounts has been an obstacle to drug and vaccine development for decades. One solution that has proven to be a successful alternative to traditional protein delivery approaches is the delivery of exogenous nucleic acid sequences for production of proteins in vivo. Gene transfer vectors ideally enter a wide variety of cell types, have the capacity to accept large nucleic acid sequences, are safe, and can be produced in quantities required for treating patients. Viral vectors are gene transfer vectors with these advantageous properties (see, e.g., Thomas et al., *Nature Review Genetics*, 4: 346-358 (2003)). Furthermore, while many viral vectors are engineered to infect a broad range of cell types, viral vectors also can be modified to target specific cell types, which can enhance the therapeutic efficacy of the vector (see, e.g., Kay et al., *Nature Medicine*, 7(1): 33-40 (2001).

Viral vectors that have been used with some success to deliver exogenous proteins to mammalian cells for therapeutic purposes include, for example, Retrovirus (see, e.g., Cavazzana-Calvo et al., *Science*, 288 (5466): 669-672 (2000)), Lentivirus (see, e.g., Cartier et al., *Science*, 326: 818-823 (2009)), Adeno-associated virus (AAV) (see, e.g., Mease et al., *Journal of Rheumatology*, 27(4): 692-703 (2010)), Herpes Simplex Virus (HSV) (see, e.g., Goins et al., *Gene Ther.*, 16(4): 558-569 (2009)), Vaccinia Virus (see, e.g., Mayrhofer et al., *J. Virol.*, 83(10): 5192-5203 (2009)), and Adenovirus (see, e.g., Lasaro and Ertl, *Molecular Therapy*, 17(8): 1333-1339 (2009)).

Despite their advantageous properties, widespread use of viral gene transfer vectors is hindered by several factors. In this respect, certain cells are not readily amenable to gene delivery by currently available viral vectors. For example, lymphocytes are impaired in the uptake of adenoviruses (Silver et al., *Virology*, 165: 377-387 (1988), and Horvath et al., *J. Virology*, 62(1): 341-345 (1988)). In addition, viral vectors that integrate into the host cell's genome (e.g., retroviral vectors) have the potential to cause insertion mutations in oncogenes (see, e.g., Cavazzana-Calvo et al., supra, and Hacein-Bey-Abina et al., *N. Engl. J. Med.*, 348: 255-256 (2003)).

The use of viral vectors for gene transfer also is impeded by the immunogenicity of viral vectors. A majority of the U.S. population has been exposed to wild-type forms of many of the viruses currently under development as gene transfer vectors (e.g., adenovirus). As a result, much of the U.S. population has developed pre-existing immunity to certain virus-based gene transfer vectors. Such vectors are quickly cleared from the bloodstream, thereby reducing the effectiveness of the vector in delivering biologically relevant amounts of a gene product. Moreover, the immunogenicity of certain viral vectors prevents efficient repeat dosing, which can be advantageous for "boosting" the immune system against pathogens when viral vectors are used in vaccine applications, thereby resulting in only a small fraction of a dose of the viral vector delivering its payload to host cells.

Thus, there remains a need for improved viral vectors that can be used to efficiently deliver genes to mammalian cells in vivo. The invention provides such viral vectors.

BRIEF SUMMARY OF THE INVENTION

The invention provides an adenovirus or adenoviral vector. The adenovirus or adenoviral vector comprises one or more of the nucleic acid sequences selected from the group consisting of (a) a nucleic acid sequence that is at least 96% identical to SEQ ID NO: 1, (b) a nucleic acid sequence that is at least 99% identical to SEQ ID NO: 2, (c) a nucleic acid sequence that is at least 80% identical to SEQ ID NO: 3, (d) a nucleic acid sequence that is at least 80% identical to SEQ ID NO: 4, and (e) a nucleic acid sequence that is at least 85.4% identical to SEQ ID NO: 5.

The invention provides an adenovirus or adenoviral vector comprising one or more of the nucleic acid sequences selected from the group consisting of (a) a nucleic acid sequence that is at least 98.7% identical to SEQ ID NO: 6, (b) a nucleic acid sequence that is at least 98.9% identical to SEQ ID NO: 7, (c) a nucleic acid sequence that is at least 99.4% identical to SEQ ID NO: 8, (d) a nucleic acid sequence that is at least 99.1% identical to SEQ ID NO: 9, (e) a nucleic acid sequence that is at least 81.25% identical to SEQ ID NO: 10, (f) a nucleic acid sequence that is at least 90.83% identical to SEQ ID NO: 11, and (g) a nucleic acid sequence that is at least 82.5% identical to SEQ ID NO: 12.

The invention provides an adenovirus or adenoviral vector comprising one or more of the nucleic acid sequences selected from the group consisting of (a) a nucleic acid sequence comprising at least 162 contiguous nucleotides of SEQ ID NO: 6, (b) a nucleic acid sequence comprising at least 162 contiguous nucleotides of SEQ ID NO: 7, (c) a nucleic acid sequence comprising at least 121 contiguous nucleotides of SEQ ID NO: 8, (d) a nucleic acid sequence comprising at least 531 contiguous nucleotides of SEQ ID NO: 9, (e) a nucleic acid sequence comprising at least 156 contiguous nucleotides of SEQ ID NO: 10, (f) a nucleic acid sequence comprising at least 192 contiguous nucleotides of SEQ ID NO: 11, and (g) a nucleic acid sequence comprising at least 84 contiguous nucleotides of SEQ ID NO: 12.

The invention provides an adenovirus or adenoviral vector comprising one or more of the amino acid sequences selected from the group consisting of (a) an amino acid sequence that is at least 85% identical to SEQ ID NO: 14, (b) an amino acid sequence that is at least 80% identical to SEQ ID NO: 15, and (c) an amino acid sequence that is at least 80% identical to SEQ ID NO: 16.

The invention provides an adenovirus or adenoviral vector comprising one or more of the nucleic acid sequences selected from the group consisting of (a) a nucleic acid sequence encoding an amino acid sequence that is at least 99.7% identical to SEQ ID NO: 13, (b) a nucleic acid sequence encoding an amino acid sequence that is at least 85% identical to SEQ ID NO: 14, (c) a nucleic acid sequence encoding an amino acid sequence that is at least 80% identical to SEQ ID NO: 15, and (d) a nucleic acid sequence encoding an amino acid sequence that is at least 80% identical to SEQ ID NO: 16.

The invention provides an adenovirus or adenoviral vector comprising one or more of the amino acid sequences selected from the group consisting of (a) an amino acid sequence that is at least 99% identical to SEQ ID NO: 18, (b) an amino acid sequence that is at least 81.4% identical to SEQ ID NO: 20, (c) an amino acid sequence that is at least 91.3% identical to SEQ ID NO: 21, and (d) an amino acid sequence that is at least 83.4% identical to SEQ ID NO: 22.

The invention provides an adenovirus or adenoviral vector comprising one or more of the nucleic acid sequences selected from the group consisting of (a) a nucleic acid sequence encoding an amino acid sequence that is at least 99% identical to SEQ ID NO: 18, (b) a nucleic acid sequence encoding an amino acid sequence that is at least 99.75% identical to SEQ ID NO: 19, (c) a nucleic acid sequence encoding an amino acid sequence that is at least 81.4% identical to SEQ ID NO: 20, (d) a nucleic acid sequence encoding an amino acid sequence that is at least 91.3% identical to SEQ ID NO: 21, (e) a nucleic acid sequence encoding an amino acid sequence that is at least 83.4% identical to SEQ ID NO: 22.

The invention provides an adenovirus or adenoviral vector comprising one or more of the amino acid sequences selected from the group consisting of (a) an amino acid sequence comprising at least 89 contiguous amino acid residues of SEQ ID NO: 18, (b) an amino acid sequence comprising at least 114 contiguous amino acid residues of SEQ ID NO: 20, (c) an amino acid sequence comprising at least 231 contiguous amino acid residues of SEQ ID NO: 21, and (d) an amino acid sequence comprising at least 30 contiguous amino acid residues of SEQ ID NO: 22.

The invention provides an adenovirus or adenoviral vector comprising one or more of the nucleic acid sequences selected from the group consisting of (a) a nucleic acid sequence encoding an amino acid sequence comprising at least 89 contiguous amino acid residues of SEQ ID NO: 18, (b) a nucleic acid sequence encoding an amino acid sequence comprising at least 428 contiguous amino acid residues of SEQ ID NO: 19, (c) a nucleic acid sequence encoding an amino acid sequence comprising at least 114 contiguous amino acid residues of SEQ ID NO: 20, (d) a nucleic acid sequence encoding an amino acid sequence comprising at least 231 contiguous amino acid residues of SEQ ID NO: 21, and (e) a nucleic acid sequence encoding an amino acid sequence comprising at least 30 contiguous amino acid residues of SEQ ID NO: 22.

DETAILED DESCRIPTION OF THE INVENTION

Adenoviruses are generally associated with benign pathologies in humans, and the genomes of adenoviruses isolated from a variety of species, including humans, have been extensively studied. Adenovirus is a medium-sized (90-100 mu), nonenveloped icosohedral virus containing approximately 36 kb of double-stranded DNA. The adenovirus capsid mediates the key interactions of the early stages of the infection of a cell by the virus, and is required for packaging adenovirus genomes at the end of the adenovirus life cycle. The capsid comprises 252 capsomeres, which includes 240 hexons, 12 penton base proteins, and 12 fibers (Ginsberg et al., *Virology*, 28: 782-83 (1966)). The hexon comprises three identical proteins, namely polypeptide II (Roberts et al., *Science*, 232: 1148-51 (1986)). The penton base comprises five identical proteins and the fiber comprises three identical proteins. Proteins IIIa, VI, and IX are present in the adenoviral coat and are believed to stabilize the viral capsid (Stewart et al., *Cell*, 67: 145-54 (1991), and Stewart et al., *EMBO J.*, 12(7): 2589-99 (1993)). The expression of the capsid proteins, with the exception of pIX, is dependent on the adenovirus polymerase protein. Therefore, major components of an adenovirus particle are expressed from the genome only when the polymerase protein gene is present and expressed.

Several features of adenoviruses make them ideal vehicles for transferring genetic material to cells for therapeutic applications (i.e. "gene therapy"), or for use as antigen delivery systems for vaccine applications. For example, adenoviruses can be produced in high titers (e.g., about $10^{13}$ particle units (pu)), and can transfer genetic material to nonreplicating and replicating cells. The adenoviral genome can be manipulated to carry a large amount of exogenous DNA (up to about 8 kb), and the adenoviral capsid can potentiate the transfer of even longer sequences (Curiel et al., *Hum. Gene Ther.*, 3: 147-154 (1992)). Additionally, adenoviruses generally do not integrate into the host cell chromosome, but rather are maintained as a linear episome, thereby minimizing the likelihood that a recombinant adenovirus will interfere with normal cell function.

The invention is predicated, at least in part, on the discovery and isolation of an adenovirus that has not previously been identified or isolated. The adenovirus described herein was isolated from a gorilla. There are four widely recognized gorilla subspecies within the two species of Eastern Gorilla (*Gorilla beringei*) and Western Gorilla (*Gorilla gorilla*). The Western Gorilla species includes the subspecies Western Lowland Gorilla (*Gorilla gorilla gorilla*) and Cross River Gorilla (*Gorilla gorilla diehli*). The Eastern Gorilla species includes the subspecies Mountain Gorilla (*Gorilla beringei beringei*) and Eastern Lowland Gorilla (*Gorilla beringei graueri*) (see, e.g., Wilson and Reeder, eds., Mammalian Species of the World, $3^{rd}$ ed., Johns Hopkins University Press, Baltimore, Md. (2005)). The adenovirus of the invention was isolated from Eastern Lowland Gorilla (*Gorilla beringei graueri*).

The genomes of several such adenoviruses have been analyzed, and it has been determined that the adenovirus can have the nucleic acid sequence of, for example, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, or SEQ ID NO: 36, each of which includes a number of sub-sequences that serve to uniquely define the adenovirus, namely the nucleic acid sequences SEQ ID NOs: 1-12, and amino acid sequences SEQ ID NOs: 13-22. SEQ ID NOs: 6-12 encode the amino acid sequences of SEQ ID NOs: 17-22, respectively. SEQ ID NOs: 1-5 are a subset of the nucleic acid sequences of SEQ ID NOs: 6 and 9-12, respectively. SEQ ID NOs: 13-16 are a subset of the amino acid sequences of SEQ ID NOs: 19-22, respectively.

The adenovirus can be modified in the same manner as previously known adenoviruses to be used as an adenoviral vector, e.g., a gene delivery vehicle.

The term "adenovirus," as used herein, refers to an adenovirus that retains the ability to participate in the adenovirus life cycle and has not been physically inactivated by, for example, disruption (e.g., sonication), denaturing (e.g., using heat or solvents), or cross-linkage (e.g., via formalin cross-linking). The "adenovirus life cycle" includes (1) virus binding and entry into cells, (2) transcription of the adenoviral genome and translation of adenovirus proteins, (3) replication of the adenoviral genome, and (4) viral particle assembly (see, e.g., Fields Virology, 5$^{th}$ ed., Knipe et al. (eds.), Lippincott Williams & Wilkins, Philadelphia, Pa. (2006)).

The term "adenoviral vector," as used herein, refers to an adenovirus in which the adenoviral genome has been manipulated to accommodate a nucleic acid sequence that is non-native with respect to the adenoviral genome. Typically, an adenoviral vector is generated by introducing one or more mutations (e.g., a deletion, insertion, or substitution) into the adenoviral genome of the adenovirus so as to accommodate the insertion of a non-native nucleic acid sequence, for example, for gene transfer, into the adenovirus.

The adenovirus and adenoviral vector can be replication-competent, conditionally replication-competent, or replication-deficient.

A replication-competent adenovirus or adenoviral vector can replicate in typical host cells, i.e., cells typically capable of being infected by an adenovirus. A replication-competent adenovirus or adenoviral vector can have one or more mutations as compared to the wild-type adenovirus (e.g., one or more deletions, insertions, and/or substitutions) in the adenoviral genome that do not inhibit viral replication in host cells. For example, the adenovirus or adenoviral vector can have a partial or entire deletion of the adenoviral early region known as the E3 region, which is not essential for propagation of the adenovirus or adenoviral genome.

A conditionally-replicating adenovirus or adenoviral vector is an adenovirus or adenoviral vector that has been engineered to replicate under pre-determined conditions. For example, replication-essential gene functions, e.g., gene functions encoded by the adenoviral early regions, can be operably linked to an inducible, repressible, or tissue-specific transcription control sequence, e.g., promoter. In such an embodiment, replication requires the presence or absence of specific factors that interact with the transcription control sequence. Conditionally-replicating adenoviral vectors are further described in U.S. Pat. No. 5,998,205.

A replication-deficient adenovirus or adenoviral vector is an adenovirus or adenoviral vector that requires complementation of one or more gene functions or regions of the adenoviral genome that are required for replication, as a result of, for example, a deficiency in one or more replication-essential gene function or regions, such that the adenovirus or adenoviral vector does not replicate in typical host cells, especially those in a human to be infected by the adenovirus or adenoviral vector.

A deficiency in a gene function or genomic region, as used herein, is defined as a disruption (e.g., deletion) of sufficient genetic material of the adenoviral genome to obliterate or impair the function of the gene (e.g., such that the function of the gene product is reduced by at least about 2-fold, 5-fold, 10-fold, 20-fold, 30-fold, or 50-fold) whose nucleic acid sequence was disrupted (e.g., deleted) in whole or in part. Deletion of an entire gene region often is not required for disruption of a replication-essential gene function. However, for the purpose of providing sufficient space in the adenoviral genome for one or more transgenes, removal of a majority of one or more gene regions may be desirable. While deletion of genetic material is preferred, mutation of genetic material by addition or substitution also is appropriate for disrupting gene function. Replication-essential gene functions are those gene functions that are required for adenovirus replication (e.g., propagation) and are encoded by, for example, the adenoviral early regions (e.g., the E1, E2, and E4 regions), late regions (e.g., the L1, L2, L3, L4, and L5 regions), genes involved in viral packaging (e.g., the IVa2 gene), and virus-associated RNAs (e.g., VA-RNA-1 and/or VA-RNA-2).

Whether the adenovirus or adenoviral vector is replication-competent or replication-deficient, the adenovirus or adenoviral vector retains at least a portion of the adenoviral genome. The adenovirus or adenoviral vector can comprise any portion of the adenoviral genome, including protein coding and non-protein coding regions. Desirably, the adenovirus or adenoviral vector comprises at least one nucleic acid sequence that encodes an adenovirus protein. The adenovirus or adenoviral vector can comprise a nucleic acid sequence that encodes any suitable adenovirus protein, such as, for example, a protein encoded by any one of the early region genes (i.e., E1A, E1B, E2A, E2B, E3, and/or E4 regions), or a protein encoded by any one of the late region genes, which encode the virus structural proteins (i.e., L1, L2, L3, L4, and L5 regions).

The adenovirus or adenoviral vector desirably comprises one or more nucleic acid sequences that encode the pIX protein, the DNA polymerase protein, the penton protein, the hexon protein, and/or the fiber protein. The adenovirus or adenoviral vector can comprise a full-length nucleic acid sequence that encodes a full-length amino acid sequence of an adenovirus protein. Alternatively, the adenovirus or adenoviral vector can comprise a portion of a full-length nucleic acid sequence that encodes a portion of a full-length amino acid sequence of an adenovirus protein.

A "portion" of a nucleic acid sequence comprises at least ten nucleotides (e.g., about 10 to about 5000 nucleotides). Preferably, a "portion" of a nucleic acid sequence comprises 10 or more (e.g., 15 or more, 20 or more, 25 or more, 30 or more, 35 or more, 40 or more, 45 or more, 50 or more, or 100 or more) nucleotides, but less than 5,000 (e.g., 4900 or less, 4000 or less, 3000 or less, 2000 or less, 1000 or less, 800 or less, 500 or less, 300 or less, or 100 or less) nucleotides. Preferably, a portion of a nucleic acid sequence is about 10 to about 3500 nucleotides (e.g., about 10, 20, 30, 50, 100, 300, 500, 700, 1000, 1500, 2000, 2500, or 3000 nucleotides), about 10 to about 1000 nucleotides (e.g., about 25, 55, 125, 325, 525, 725, or 925 nucleotides), or about 10 to about 500 nucleotides (e.g., about 15, 30, 40, 50, 60, 70, 80, 90, 150, 175, 250, 275, 350, 375, 450, 475, 480, 490, 495, or 499 nucleotides), or a range defined by any two of the foregoing values. More preferably, a "portion" of a nucleic acid sequence comprises no more than about 3200 nucleotides (e.g., about 10 to about 3200 nucleotides, about 10 to about 3000 nucleotides, or about 30 to about 500 nucleotides, or a range defined by any two of the foregoing values).

A "portion" of an amino acid sequence comprises at least three amino acids (e.g., about 3 to about 1,200 amino acids). Preferably, a "portion" of an amino acid sequence comprises 3 or more (e.g., 5 or more, 10 or more, 15 or more, 20 or more, 25 or more, 30 or more, 40 or more, or 50 or more) amino acids, but less than 1,200 (e.g., 1,000 or less, 800 or less, 700 or less, 600 or less, 500 or less, 400 or less, 300 or less, 200 or less, or 100 or less) amino acids. Preferably, a portion of an amino acid sequence is about 3 to about 500 amino acids (e.g., about 10, 100, 200, 300, 400, or 500 amino acids), about 3 to about 300 amino acids (e.g., about 20, 50, 75, 95, 150, 175, or 200 amino acids), or about 3 to about 100 amino acids (e.g., about 15, 25, 35, 40, 45, 60, 65, 70, 80, 85, 90, 95, or 99 amino acids), or a range defined by any two of the foregoing values. More preferably, a "portion" of an amino acid sequence comprises no more than about 500 amino acids (e.g., about 3 to about 400 amino acids, about 10 to about 250 amino acids, or about 50 to about 100 amino acids, or a range defined by any two of the foregoing values).

The adenovirus pIX protein is present in the adenovirus capsid, has been shown to strengthen hexon nonamer interactions, and is essential for the packaging of full-length genomes (see, e.g., Boulanger et al., *J. Gen. Virol.*, 44: 783-800 (1979); Horwitz M. S., "Adenoviridae and their replication" in *Virology*, 2nd ed., B. N. Fields et al. (eds.), Raven Press, Ltd., New York, pp. 1679-1721 (1990), Ghosh-Choudhury et al., *EMBO J.*, 6: 1733-1739 (1987), and van Oostrum et al, *J. Virol.*, 56: 439-448 (1985)). In addition to its contribution to adenovirus structure, pIX also has been shown to exhibit transcriptional properties, such as stimulation of adenovirus major late promoter (MLP) activity (see, e.g., Lutz et al., *J. Virol.*, 71(7): 5102-5109 (1997)). Nucleic acid sequences that encode all or a portion of an adenovirus pIX protein include, for example, SEQ ID NO: 6, SEQ ID NO: 7, SEQ ID NO: 8. SEQ ID NO: 1 is a subset of SEQ ID NO: 6. Amino acid sequences that comprise a full-length pIX protein, or a portion thereof, include, for example, SEQ ID NO: 17 and SEQ ID NO: 18.

The adenovirus DNA polymerase protein is essential for viral DNA replication both in vitro and in vivo. The polymerase co-purifies in a complex with the precursor (pTP) of the terminal protein (TP), which is covalently attached to the 5' ends of adenovirus DNA (Field et al., *J. Biol. Chem.*, 259: 9487-9495 (1984)). Both the adenovirus DNA polymerase and pTP are encoded by the E2 region. The polymerase protein is required for the expression of all the structural proteins except for pIX. Without the gene sequence for polymerase protein, polymerase protein is not produced. As a result, the viral genome is not replicated, the Major Late Promoter is not activated, and the capsid proteins are not expressed. Nucleic acid sequences that encode all or a portion of an adenovirus DNA polymerase protein include, for example, SEQ ID NO: 9. SEQ ID NO: 2 is a subset of SEQ ID NO: 9. Amino acid sequences that comprise a full-length adenovirus DNA polymerase, or a portion thereof, include, for example, SEQ ID NO: 19 and SEQ ID NO: 13.

The adenovirus hexon protein is the largest and most abundant protein in the adenovirus capsid. The hexon protein is essential for virus capsid assembly, determination of the icosahedral symmetry of the capsid (which in turn defines the limits on capsid volume and DNA packaging size), and integrity of the capsid. In addition, hexon is a primary target for modification in order to reduce neutralization of adenoviral vectors (see, e.g., Gall et al., *J. Virol.*, 72: 10260-264 (1998), and Rux et al., *J. Virol.*, 77(17): 9553-9566 (2003)). The major structural features of the hexon protein are shared by adenoviruses across serotypes, but the hexon protein differs in size and immunological properties between serotypes (Jornvall et al., *J. Biol. Chem.*, 256(12): 6181-6186 (1981)). A comparison of 15 adenovirus hexon proteins revealed that the predominant antigenic and serotype-specific regions of the hexon appear to be in loops 1 and 2 (i.e., LI or l1, and LII or l2, respectively), within which are seven discrete hypervariable regions (HVR1 to HVR7) varying in length and sequence between adenoviral serotypes (Crawford-Miksza et al., *J. Virol.*, 70(3): 1836-1844 (1996)). Nucleic acid sequences that encode all or a portion of an adenovirus hexon protein include, for example, SEQ ID NO: 11 and SEQ ID NO: 4. Amino acid sequences that comprise a full-length adenovirus hexon protein, or a portion thereof, include, for example, SEQ ID NO: 21 and SEQ ID NO: 15.

The adenovirus fiber protein is a homotrimer of the adenoviral polypeptide IV that has three domains: the tail, shaft, and knob. (Devaux et al., *J. Molec. Biol.*, 215: 567-88 (1990), Yeh et al., *Virus Res.*, 33: 179-98 (1991)). The fiber protein mediates primary viral binding to receptors on the cell surface via the knob and the shaft domains (Henry et al., *J. Virol.*, 68(8): 5239-46 (1994)). The amino acid sequences for trimerization are located in the knob, which appears necessary for the amino terminus of the fiber (the tail) to properly associate with the penton base (Novelli et al., *Virology*, 185: 365-76 (1991)). In addition to recognizing cell receptors and binding the penton base, the fiber contributes to serotype identity. Fiber proteins from different adenoviral serotypes differ considerably (see, e.g., Green et al., *EMBO J.*, 2: 1357-65 (1983), Chroboczek et al., *Virology*, 186: 280-85 (1992), and Signas et al., *J. Virol.*, 53: 672-78 (1985)). Thus, the fiber protein has multiple functions key to the life cycle of adenovirus. Nucleic acid sequences that encode all or a portion of an adenovirus fiber protein include, for example, SEQ ID NO: 12 and SEQ ID NO: 5. Amino acid sequences that comprise a full-length adenovirus fiber protein, or a portion thereof, include, for example, SEQ ID NO: 22 and SEQ ID NO: 16.

The adenovirus penton base protein is located at the vertices of the icosahedral capsid and comprises five identical monomers. The penton base protein provides a structure for bridging the hexon proteins on multiple facets of the icosahedral capsid, and provides the essential interface for the fiber protein to be incorporated in the capsid. Each monomer of the penton base contains an RGD tripeptide motif (Neumann et al., *Gene*, 69: 153-157 (1988)). The RGD tripeptide mediates binding to αv integrins and adenoviruses that have point mutations in the RGD sequence of the penton base are restricted in their ability to infect cells (Bai et al., *J. Virol.*, 67: 5198-5205 (1993)). Thus, the penton base protein is essential for the architecture of the capsid and for maximum efficiency of virus-cell interaction. Nucleic acid sequences that encode all or a portion of an adenovirus penton base protein include, for example, SEQ ID NO: 10 and SEQ ID NO: 3. Amino acid sequences that comprise a full-length adenovirus penton base protein, or a portion thereof, include, for example, SEQ ID NO: 20 and SEQ ID NO: 14.

Nucleic acid or amino acid sequence "identity," as described herein, can be determined by comparing a nucleic acid or amino acid sequence of interest to a reference nucleic acid or amino acid sequence. The number of nucleotides or amino acid residues that have been changed and/or modified (such as, e.g., by point mutations, insertions, or deletions) in the reference sequence so as to result in the sequence of interest are counted. The total number of such changes is subtracted from the total length of the sequence of interest, and the difference is divided by the length of the sequence of interest and expressed as a percentage. A number of mathematical algorithms for obtaining the optimal alignment and calculating identity between two or more sequences are known and incorporated into a number of available software programs. Examples of such programs include CLUSTAL-W, T-Coffee, and ALIGN (for alignment of nucleic acid and amino acid sequences), BLAST programs (e.g., BLAST 2.1, BL2SEQ, and later versions thereof) and FASTA programs (e.g., FASTA3x, FASTM, and SSEARCH) (for sequence alignment and sequence similarity searches). Sequence alignment algorithms also are disclosed in, for example, Altschul et al., *J. Molecular Biol.*, 215(3): 403-410 (1990), Beigert et al., *Proc. Natl. Acad. Sci. USA*, 106(10): 3770-3775 (2009), Durbin et al., eds., *Biological Sequence Analysis: Probalistic Models of Proteins and Nucleic Acids*, Cambridge University Press, Cambridge, UK (2009), Soding, *Bioinformatics*, 21(7): 951-960 (2005), Altschul et al., *Nucleic Acids Res.*, 25(17): 3389-3402 (1997), and Gusfield, *Algorithms on Strings, Trees and Sequences*, Cambridge University Press, Cambridge UK (1997)).

In one embodiment, the adenovirus or adenoviral vector comprises one or more of the following nucleic acid sequences: (a) a nucleic acid sequence that is at least 96% identical (e.g., at least 96% or 100% identical) to SEQ ID NO: 1, (b) a nucleic acid sequence that is at least 99% identical (e.g., at least 99.08%, at least 99.16%, at least 99.23%, at least 99.31%, at least 99.39%, at least 99.47%, at least 99.55%, at least 99.62%, at least 99.70%, at least 99.78%, at least 99.86%, at least 99.93%, or 100% identical) to SEQ ID NO: 2, (c) a nucleic acid sequence that is at least 80% identical (e.g., at least 82%, at least 84.22%, at least 86.44%, at least 88.67%, at least 90.89%, at least 93.11%, at least 95.33%, at least 97.56%, at least 99.78%, or 100% identical) to SEQ ID NO: 3, (d) a nucleic acid sequence that is at least 80% identical (e.g., at least 80.58%, at least 82.67%, at least 84.75%, at least 86.83%, at least 88.92%, at least 91.00%, at least 93.08%, at least 95.17%, at least 97.25%, at least 99.33%, or 100% identical) to SEQ ID NO: 4, and (e) a nucleic acid sequence that is at least 85.4% identical (e.g., at least 87.48%, at least 89.57%, at least 91.65%, at least 93.73%, at least 95.82%, at least 97.90%, at least 99.98%, or 100% identical) to SEQ ID NO: 5.

The adenovirus or adenoviral vector can comprise one, two, three, four, or all five of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, or all five of the aforementioned sequences. For example, the adenovirus or adenoviral vector can comprise a nucleic acid sequence that is at least 96% identical to SEQ ID NO: 1. The adenovirus or adenoviral vector can comprise a nucleic acid sequence that is at least 99% identical to SEQ ID NO: 2 and a nucleic acid sequence that is at least 80% identical to SEQ ID NO: 3. The adenovirus or adenoviral vector can comprise a nucleic acid sequence that is at least 96% identical to SEQ ID NO: 1, a nucleic acid sequence that is at least 80% identical to SEQ ID NO: 3, and a nucleic acid sequence that is at least 85.4% identical to SEQ ID NO: 5. The adenovirus or adenoviral vector can comprise (a) the nucleic acid sequence of SEQ ID NO: 1, (b) the nucleic acid sequence SEQ ID NO: 2, (c) the nucleic acid sequence of SEQ ID NO: 3, (d) the nucleic acid sequence of SEQ ID NO: 4, or (e) the nucleic acid sequence of SEQ ID NO: 5. The adenovirus or adenoviral vector can comprise (a) a nucleic acid sequence that is at least 96% identical to SEQ ID NO: 1, (b) a nucleic acid sequence that is at least 99% identical to SEQ ID NO: 2, (c) a nucleic acid sequence that is at least 80% identical to SEQ ID NO: 3, (d) a nucleic acid sequence that is at least 80% identical to SEQ ID NO: 4, and (e) a nucleic acid sequence that is at least 85.4% identical to SEQ ID NO: 5. The adenovirus or adenoviral vector can comprise (a) the nucleic acid sequence of SEQ ID NO: 1, (b) the nucleic acid sequence SEQ ID NO: 2, (c) the nucleic acid sequence of SEQ ID NO: 3, (d) the nucleic acid sequence of SEQ ID NO: 4, and (e) the nucleic acid sequence of SEQ ID NO: 5.

In another embodiment, the adenovirus or adenoviral vector comprises one or more of the following nucleic acid sequences: (a) a nucleic acid sequence that is at least 98.7% identical (e.g., at least 98.95%, at least 99.20%, at least 99.45%, at least 99.70%, at least 99.95%, or 100% identical) to SEQ ID NO: 6, (b) a nucleic acid sequence that is at least 98.9% identical (e.g., at least 99.15%, at least 99.40%, at least 99.65%, at least 99.90%, or 100% identical) to SEQ ID NO: 7, (c) a nucleic acid sequence that is at least 99.4% identical (e.g., at least 99.65%, at least 99.90%, or 100% identical) to SEQ ID NO: 8, (d) a nucleic acid sequence that is at least 99.1% identical (e.g., at least 99.13%, at least 99.16%, at least 99.19%, at least 99.23%, at least 99.26%, at least 99.29%, at least 99.32%, at least 99.35%, at least 99.38%, at least 99.42%, at least 99.45%, at least 99.48%, at least 99.51%, at least 99.54%, at least 99.57%, at least 99.61%, at least 99.64%, at least 99.67%, at least 99.70%, at least 99.73%, at least 99.76%, at least 99.79%, at least 99.83%, at least 99.86%, at least 99.89%, at least 99.92%, at least 99.95%, at least 99.98%, or 100% identical) to SEQ ID NO: 9, (e) a nucleic acid sequence that is at least 81.25% identical (e.g., at least 81.30%, at least 81.36%, at least 81.41%, at least 81.46%, at least 81.52%, at least 81.57%, at least 81.63%, at least 81.68%, at least 81.73%, at least 81.79%, at least 81.84%, at least 81.89%, at least 81.95%, at least 82.00%, at least 82.06%, at least 82.11%, at least 82.16%, at least 82.22%, at least 82.27%, at least 82.32%, at least 82.38%, at least 82.43%, at least 82.48%, at least 82.54%, at least 82.59%, at least 82.65%, at least 82.70%, at least 82.75%, at least 82.81%, at least 82.86%, at least 82.91%, at least 82.97%, at least 83.02, at least 83.08%, at least 83.13%, at least 83.18%, at least 83.24%, at least 83.29%, at least 83.34%, at least 83.40%, at least 83.45%, at least 83.50%, at least 83.56%, at least 83.61%, at least 83.67%, at least 83.72%, at least 83.77%, at least 83.83%, at least 83.88%, at least 83.93%, at least 83.99%, at least 84.04%, at least 84.09%, at least 84.15%, at least 84.20%, at least 84.26%, at least 84.31%, at least 84.36%, at least 84.42%, at least 84.47%, at least 84.52%, at least 84.58%, at least 84.63%, at least 84.69%, at least 84.74%, at least 84.79%, at least 84.85%, at least 84.90%, at least 84.95%, at least 85.01%, at least 85.06%, at least 85.11%, at least 85.17%, at least 85.22%, at least 85.28%, at least 85.33%, at least 85.38%, at least 85.44%, at least 85.49%, at least 85.54%, at least 85.60%, at least 85.65%, at least 85.71%, at least 85.76%, at least 85.81%, at least 85.87%, at least 85.92%, at least 85.97%, at least 86.03%, at least 86.08%, at least 86.13%, at least 86.19%, at least 86.24%, at least 86.30%, at least 86.35%, at least 86.40%, at least 86.46%, at least 86.51%, at least 86.56%, at least 86.62%, at least 86.67%, at least 86.73%, at least 86.78%, at least 86.83%, at least 86.89%, at least 86.94%, at least 86.99%, at least 87.05%, at least 87.10%, at least 87.15%, at least 87.21%, at least 87.26%, at least 87.32%, at least 87.37%, at least 87.42%, at least 87.48%, at least 87.53%, at least 87.58%, at least 87.64%, at least 87.69%, at least 87.74%, at least 87.80%, at least 87.85%, at least 87.91%, at least 87.96%, at least 88.01%, at least 88.07%, at least 88.12%, at least 88.17%, at least 88.23%, at least 88.28%, at least 88.34%, at least 88.39%, at least 88.44%, at least 88.50%, at least 88.55%, at least 88.60%, at least 88.66%, at least 88.71%, at least 88.76%, at least 88.82%, at least 88.87%, at least 88.93%, at least at least 88.98%, at least 89.03%, at least 89.09%, at least 89.14%, at least 89.19%, at least 89.25%, at least 89.30%, 89.36%, at least 89.41%, at least 89.46%, at least 89.52%, at least 89.57%, at least 89.62%, at least 89.68%, at least 89.73%, at least 89.78%, at least 89.84%, at least 89.89%, at least 89.95%, at least 90.00%, at least 90.05%, at least 90.11%, at least 90.16%, at least 90.21%, at least 90.27%, at least 90.32%, at least 90.38%, at least 90.43%, at least 90.48%, at least 90.54%, at least 90.59%, at least 90.64%, at least 90.70%, at least 90.75%, at least 90.80%, at least 90.86%, at least 90.91%, at least 90.97%, at least 91.02%, at least 91.07%, at least 91.13%, at least 91.18%, at least 91.23%, at least 91.29%, at least 91.34%, at least 91.39%, at least 91.45%, at least 91.50%, at least 91.56%, at least 91.61%, at least 91.66%, at least 91.72%, at least 91.77%, at least 91.82%, at least 91.88%, at least 91.93%, at least 91.99%, at least 92.04%, at least 92.09%, at least 92.15%, at least 92.20%, at least 92.25%, at least 92.31%, at least 92.36%, at least 92.41%, at least 92.47%, at least 92.52%, at least 92.58%, at least 92.63%, at least 92.68%, at least 92.74%, at least 92.79%, at least 92.84%, at least 92.90%, at least 92.95%, at least 93.01%, at least 93.06%, at least 93.11%, at least 93.17%, at least 93.22%, at least 93.27%, at least 93.33%, at least 93.38%, at least 93.43%, at least 93.49%, at least 93.54%, at least 93.60%, at least 93.65%, at least 93.70%, at least 93.76%, at least 93.81%, at least 93.86%, at least 93.92%, at least 93.97%, at least 94.03%, at least 94.08%, at least 94.13%, at least 94.19%, at least 94.24%, at least 94.29%, at least 94.35%, at least 94.40%, at least 94.45%, at least 94.51%, at least 94.56%, at least 94.62%, at least 94.67%, at least 94.72%, at least 94.78%, at least 94.83%, at least 94.88%, at least 94.94%, at least 94.99%, at least 95.04%, at least 95.10%, at least 95.15%, at least 95.21%, at least 95.26%, at least 95.31%, at least 95.37%, at least 95.42%, at least 95.47%, at least 95.53%, at least 95.58%, at least 95.64%, at least 95.69%, at least 95.74%, at least 95.80%, at least 95.85%, at least 95.90%, at least 95.96%, at least 96.01%, at least 96.06%, at least 96.12%, at least 96.17%, at least 96.23%, at least 96.28%, at least 96.33%, at least 96.39%, at least 96.44%, at least 96.49%, at least 96.55%, at least 96.60%, at least 96.66%, at least 96.71%, at least 96.76%, at least 96.82%, at least 96.87%, at least 96.92%, at least 96.98%, at least 97.03%, at least 97.08%, at least 97.14%, at least 97.19%, at least 97.25%, at least 97.30%, at least 97.35%, at least 97.41%, at least 97.46%, at least 97.51%, at least 97.57%, at least 97.62%, at least 97.68%, at least 97.73%, at least 97.78%, at least 97.84%, at least 97.89%, at least 97.94%, at least 98.00%, at least 98.05%, at least 98.10%, at least 98.16%, at least 98.21%, at least 98.27%, at least 98.32%, at least 98.37%, at least 98.43%, at least 98.48%, at least 98.53%, at least 98.59%, at least 98.64%, at least 98.69%, at least 98.75%, at least 98.80%, at least 98.86%, at least 98.91%, at least 98.96%, at least 99.02%, at least 99.07%, at least 99.12%, at least 99.18%, at least 99.23%, at least 99.29%, at least 99.34%, at least 99.39%, at least 99.45%, at least 99.50%, at least 99.55%, at least 99.61%, at least 99.66%, at least 99.71%, at least 99.77%, at least 99.82%, at least 99.88%, at least 99.93%, at least 99.98%, or 100% identical) to SEQ ID NO: 10, (f) a nucleic acid sequence that is at least 90.83% identical (e.g., at least 90.87%, at least 90.90%, at least 90.94%, at least 90.97%, at least 91.01%, at least 91.04%, at least 91.08%, at least 91.11%, at least 91.15%, at least 91.18%, at least 91.22%, at least 91.25%, at least 91.29%, at least 91.32%, at least 91.36%, at least 91.39%, at least 91.43%, at least 91.46%, at least 91.50%, at least 91.53%, at least 91.57%, at least 91.60%, at least 91.64%, at least 91.67%, at least 91.71%, at least 91.75%, at least 91.78%, at least 91.82%, at least 91.85%, at least 91.89%, at least 91.92%, at least 91.96%, at least 91.99%, at least 92.03%, at least 92.06%, at least 92.10%, at least 92.13%, at least 92.17%, at least 92.20%, at least 92.24%, at least 92.27%, at least 92.31%, at least 92.34%, at least 92.38%, at least 92.41%, at least 92.45%, at least 92.48%, at least 92.52%, at least 92.55%, at least 92.59%, at least 92.63%, at least 92.66%, at least 92.70%, at least 92.73%, at least 92.77%, at least 92.80%, at least 92.84%, at least 92.87%, at least 92.91%, at least 92.94%, at least 92.98%, at least 93.01%, at least 93.05%, at least 93.08%, at least 93.12%, at least 93.15%, at least 93.19%, at least 93.22%, at least 93.26%, at least 93.29%, at least 93.33%, at least 93.36%, at least 93.40%, at least 93.43%, at least 93.47%, at least 93.51%, at least 93.54%, at least 93.58%, at least 93.61%, at least 93.65%, at least 93.68%, at least 93.72%, at least 93.75%, at least 93.79%, at least 93.82%, at least 93.86%, at least 93.89%, at least 93.93%, at least 93.96%, at least 94.00%, at least 94.03%, at least 94.07%, at least 94.10%, at least 94.14%, at least 94.17%, at least 94.21%, at least 94.24%, at least 94.28%, at least 94.31%, at least 94.35%, at least 94.39%, at least 94.42%, at least 94.46%, at least 94.49%, at least 94.53%, at least 94.56%, at least 94.60%, at least 94.63%, at least 94.67%, at least 94.70%, at least 94.74%, at least 94.77%, at least 94.81%, at least 94.84%, at least 94.88%, at least 94.91%, at least 94.95%, at least 94.98%, at least 95.02%, at least 95.05%, at least 95.09%, at least 95.12%, at least 95.16%, at least 95.19%, at least 95.23%, at least 95.27%, at least 95.30%, at least 95.34%, at least 95.37%, at least 95.41%, at least 95.44%, at least 95.48%, at least 95.51%, at least 95.55%, at least 95.58%, at least 95.62%, at least 95.65%, at least 95.69%, at least 95.72%, at least 95.76%, at least 95.79%, at least 95.83%, at least 95.86%, at least 95.90%, at least 95.93%, at least 95.97%, at least 96.00%, at least 96.04%, at least 96.07%, at least 96.11%, at least 96.15%, at least 96.18%, at least 96.22%, at least 96.25%, at least 96.29%, at least 96.32%, at least 96.36%, at least 96.39%, at least 96.43%, at least 96.46%, at least 96.50%, at least 96.53%, at least 96.57%, at least 96.60%, at least 96.64%, at least 96.67%, at least 96.71%, at least 96.74%, at least 96.78%, at least 96.81%, at least 96.85%, at least 96.88%, at least 96.92%, at least 96.95%, at least 96.99%, at least 97.03%, at least 97.06%, at least 97.10%, at least 97.13%, at least 97.17%, at least 97.20%, at least 97.24%, at least 97.27%, at least 97.31%, at least 97.34%, at least 97.38%, at least 97.41%, at least 97.45%, at least 97.48%, at least 97.52%, at least 97.55%, at least 97.59%, at least 97.62%, at least 97.66%, at least 97.69%, at least 97.73%, at least 97.76%, at least 97.80%, at least 97.83%, at least 97.87%, at least 97.90%, at least 97.94%, at least 97.98%, at least 98.01%, at least 98.05%, at least 98.08%, at least 98.12%, at least 98.15%, at least 98.19%, at least 98.22%, at least 98.26%, at least 98.29%, at least 98.33%, at least 98.36%, at least 98.40%, at least 98.43%, at least 98.47%, at least 98.50%, at least 98.54%, at least 98.57%, at least 98.61%, at least 98.64%, at least 98.68%, at least 98.71%, at least 98.75%, at least 98.78%, at least 98.82%, at least 98.86%, at least 98.89%, at least 98.93%, at least 98.96%, at least 99.00%, at least 99.03%, at least 99.07%, at least 99.10%, at least 99.14%, at least 99.17%, at least 99.21%, at least 99.24%, at least 99.28%, at least 99.31%, at least 99.35%, at least 99.38%, at least 99.42%, at least 99.45%, at least 99.49%, at least 99.52%, at least 99.56%, at least 99.59%, at least 99.63%, at least 99.66%, at least 99.70%, at least 99.74%, at least 99.77%, at least 99.81%, at least 99.84%, at least 99.88%, at least 99.91%, at least 99.95%, at least 99.98%, or 100% identical) to SEQ ID NO: 11, and (g) a nucleic acid sequence that is at least 82.5% identical (e.g., at least 82.56%, at least 82.61%, at least 82.67%, at least 82.73%, at least 82.79%, at least 82.84%, at least 82.90%, at least 82.96%, at least 83.02%, at least 83.07%, at least 83.13%, at least 83.19%, at least 83.25%, at least 83.30%, at least 83.36%, at least 83.42%, at least 83.48%, at least 83.53%, at least 83.59%, at least 83.65%, at least 83.71%, at least 83.76%, at least 83.82%, at least 83.88%, at least 83.94%, at least 83.99%, at least 84.05%, at least 84.11%, at least 84.17%, at least 84.22%, at least 84.28%, at least 84.34%, at least 84.40%, at least 84.45%, at least 84.51%, at least 84.57%, at least 84.63%, at least 84.68%, at least 84.74%, at least 84.80%, at least 84.86%, at least 84.91%, at least 84.97%, at least 85.03%, at least 85.09%, at least 85.14%, at least 85.20%, at least 85.26%, at least 85.32%, at least 85.37%, at least 85.43%, at least 85.49%, at least 85.55%, at least 85.60%, at least 85.66%, at least 85.72%, at least 85.78%, at least 85.83%, at least 85.89%, at least 85.95%, at least 86.01%, at least 86.06%, at least 86.12%, at least 86.18%, at least 86.24%, at least 86.29%, at least 86.35%, at least 86.41%, at least 86.47%, at least 86.52%, at least 86.58%, at least 86.64%, at least 86.70%, at least 86.75%, at least 86.81%, at least 86.87%, at least 86.93%, at least 86.98%, at least 87.04%, at least 87.10%, at least 87.16%, at least 87.21%, at least 87.27%, at least 87.33%, at least 87.39%, at least 87.44%, at least 87.50%, at least 87.56%, at least 87.61%, at least 87.67%, at least 87.73%, at least 87.79%, at least 87.84%, at least 87.90%, at least 87.96%, at least 88.02%, at least 88.07%, at least 88.13%, at least 88.19%, at least 88.25%, at least 88.30%, at least 88.36%, at least 88.42%, at least 88.48%, at least 88.53%, at least 88.59%, at least 88.65%, at least 88.71%, at least 88.76%, at least 88.82%, at least 88.88%, at least 88.94%, at least 88.99%, at least 89.05%, at least 89.11%, at least 89.17%, at least 89.22%, at least 89.28%, at least 89.34%, at least 89.40%, at least 89.45%, at least 89.51%, at least 89.57%, at least 89.63%, at least 89.68%, at least 89.74%, at least 89.80%, at least 89.86%, at least 89.91%, at least 89.97%, at least 90.03%, at least 90.09%, at least 90.14%, at least 90.20%, at least 90.26%, at least 90.32%, at least 90.37%, at least 90.43%, at least 90.49%, at least 90.55%, at least 90.60%, at least 90.66%, at least 90.72%, at least 90.78%, at least 90.83%, at least 90.89%, at least 90.95%, at least 91.01%, at least 91.06%, at least 91.12%, at least 91.18%, at least 91.24%, at least 91.29%, at least 91.35%, at least 91.41%, at least 91.47%, at least 91.52%, at least 91.58%, at least 91.64%, at least 91.70%, at least 91.75%, at least 91.81%, at least 91.87%, at least 91.93%, at least 91.98%, at least 92.04%, at least 92.10%, at least 92.16%, at least 92.21%, at least 92.27%, at least 92.33%, at least 92.39%, at least 92.44%, at least 92.50%, at least 92.56%, at least 92.61%, at least 92.67%, at least 92.73%, at least 92.79%, at least 92.84%, at least 92.90%, at least 92.96%, at least 93.02%, at least 93.07%, at least 93.13%, at least 93.19%, at least 93.25%, at least 93.30%, at least 93.36%, at least 93.42%, at least 93.48%, at least 93.53%, at least 93.59%, at least 93.65%, at least 93.71%, at least 93.76%, at least 93.82%, at least 93.88%, at least 93.94%, at least 93.99%, at least 94.05%, at least 94.11%, at least 94.17%, at least 94.22%, at least 94.28%, at least 94.34%, at least 94.40%, at least 94.45%, at least 94.51%, at least 94.57%, at least 94.63%, at least 94.68%, at least 94.74%, at least 94.80%, at least 94.86%, at least 94.91%, at least 94.97%, at least 95.03%, at least 95.09%, at least 95.14%, at least 95.20%, at least 95.26%, at least 95.32%, at least 95.37%, at least 95.43%, at least 95.49%, at least 95.55%, at least 95.60%, at least 95.66%, at least 95.72%, at least 95.78%, at least 95.83%, at least 95.89%, at least 95.95%, at least 96.01%, at least 96.06%, at least 96.12%, at least 96.18%, at least 96.24%, at least 96.29%, at least 96.35%, at least 96.41%, at least 96.47%, at least 96.52%, at least 96.58%, at least 96.64%, at least 96.70%, at least 96.75%, at least 96.81%, at least 96.87%, at least 96.93%, at least 96.98%, at least 97.04%, at least 97.10%, at least 97.16%, at least 97.21%, at least 97.27%, at least 97.33%, at least 97.39%, at least 97.44%, at least 97.50%, at least 97.56%, at least 97.61%, at least 97.67%, at least 97.73%, at least 97.79%, at least 97.84%, at least 97.90%, at least 97.96%, at least 98.02%, at least 98.07%, at least 98.13%, at least 98.19%, at least 98.25%, at least 98.30%, at least 98.36%, at least 98.42%, at least 98.48%, at least 98.53%, at least 98.59%, at least 98.65%, at least 98.71%, at least 98.76%, at least 98.82%, at least 98.88%, at least 98.94%, at least 98.99%, at least 99.05%, at least 99.11%, at least 99.17%, at least 99.22%, at least 99.28%, at least 99.34%, at least 99.40%, at least 99.45%, at least 99.51%, at least 99.57%, at least 99.63%, at least 99.68%, at least 99.74%, at least 99.80%, at least 99.86%, at least 99.91%, at least 99.97%, or 100% identical) to SEQ ID NO: 12.

The adenovirus or adenoviral vector can comprise one, two, three, four, five, six or all seven of the aforementioned sequences alone or in any combination. In this respect, the adenovirus or adenoviral vector can comprise any combination of any two of the aforementioned sequences, any combination of any three of the aforementioned sequences, any combination of any four of the aforementioned sequences, any combination of any five of the aforementioned sequences, or all six of the aforementioned sequences. For example, the adenovirus or adenoviral vector can comprise a nucleic acid sequence that is at least 98.7% identical to SEQ ID NO: 6. The adenovirus or adenoviral vector can comprise a nucleic acid sequence that is at least 81.25% identical to SEQ ID NO: 10 and a nucleic acid sequence that is at least 82.50% identical to SEQ ID NO: 12. The adenovirus or adenoviral vector can comprise a nucleic acid sequence that is at least 99.4% identical to SEQ ID NO: 8, a nucleic acid sequence that is at least 99.1% identical to SEQ ID NO: 9, a nucleic acid sequence that is at least 81.25% identical to SEQ ID NO: 10, and a nucleic acid sequence that is at least 82.5% identical to SEQ ID NO: 12. The adenovirus or adenoviral vector can comprise (a) the nucleic acid sequence of SEQ ID NO: 6, (b) the nucleic acid sequence of SEQ ID NO: 9, (c) the nucleic acid sequence of SEQ ID NO: 10, (d) the nucleic acid sequence of SEQ ID NO: 11, or (e) the nucleic acid sequence of SEQ ID NO: 12. The adenovirus or adenoviral vector can comprise (a) a nucleic acid sequence that is at least 99.4% identical to SEQ ID NO: 8, (b) a nucleic acid sequence that is at least 99.1% identical to SEQ ID NO: 9, (c) a nucleic acid sequence that is at least 81.25% identical to SEQ ID NO: 10, (d) a nucleic acid sequence that is at least 90.83% identical to SEQ ID NO: 11, and (e) a nucleic acid sequence that is at least 82.5% identical to SEQ ID NO: 12. The adenovirus or adenoviral vector can comprise (a) the nucleic acid sequence SEQ ID NO: 7, (b) the nucleic acid sequence of SEQ ID NO: 9, (c) the nucleic acid sequence of SEQ ID NO: 10, (d) the nucleic acid sequence of SEQ ID NO: 11, and (e) the nucleic acid sequence of SEQ ID NO: 12.

In another embodiment, the adenovirus or adenoviral vector comprises one or more of the following nucleic acid sequences: (a) a nucleic acid sequence comprising at least 162 contiguous nucleotides of SEQ ID NO: 6, (b) a nucleic acid sequence comprising at least 162 contiguous nucleotides of SEQ ID NO: 7, (c) a nucleic acid sequence comprising at least 121 contiguous nucleotides of SEQ ID NO: 8, (d) a nucleic acid sequence comprising at least 531 contiguous nucleotides of SEQ ID NO: 9, (e) a nucleic acid sequence comprising at least 156 contiguous nucleotides of SEQ ID NO: 10, (f) a nucleic acid sequence comprising at least 192 contiguous nucleotides of SEQ ID NO: 11, or (g) a nucleic acid sequence comprising at least 84 contiguous nucleotides of SEQ ID NO: 12.

The adenovirus or adenoviral vector can comprise a nucleic acid sequence comprising at least 162 (e.g., 165 or more, 170 or more, 190 or more, 200 or more, 250 or more, or 300 or more) contiguous nucleotides of SEQ ID NO: 6, but no more than 399 (e.g., 398 or less, 350 or less, or 275 or less) contiguous nucleotides of SEQ ID NO: 6. Preferably, the adenovirus or adenoviral vector comprises a nucleic acid sequence comprising 162 to 300 contiguous nucleotides (e.g., 163, 175, 200, 250, or 275 contiguous nucleotides), or 162 to 200 contiguous nucleotides (e.g., 164, 166, 167, 168, 169, 171, 172, 173, 174, 176, 177, 178, 179, 180, 181, 182, 183, 184, 185, 186, 187, 188, 189, 191, 192, 193, 194, 195, 196, 197, 198, or 199 contiguous nucleotides) of SEQ ID NO: 6, or a range defined by any two of the foregoing values.

The adenovirus or adenoviral vector can comprise a nucleic acid sequence comprising at least 162 (e.g., 165 or more, 170 or more, 190 or more, 200 or more, 250 or more, or 300 or more) contiguous nucleotides of SEQ ID NO: 7, but no more than 399 (e.g., 398 or less, 350 or less, or 275 or less) contiguous nucleotides of SEQ ID NO: 7. Preferably, the adenovirus or adenoviral vector comprises a nucleic acid sequence comprising 162 to 300 contiguous nucleotides (e.g., 163, 175, 200, 250, or 275 contiguous nucleotides), or 162 to 200 contiguous nucleotides (e.g., 164, 166, 167, 168, 169, 171, 172, 173, 174, 176, 177, 178, 179, 180, 181, 182, 183, 184, 185, 186, 187, 188, 189, 191, 192, 193, 194, 195, 196, 197, 198, or 199 contiguous nucleotides) of SEQ ID NO: 7, or a range defined by any two of the foregoing values.

The adenovirus or adenoviral vector can comprise a nucleic acid sequence comprising at least 121 (e.g., 125 or more, 130 or more, 150 or more, 200 or more, 250 or more, or 300 or more) contiguous nucleotides of SEQ ID NO: 8, but no more than 399 (e.g., 398 or less, 350 or less, or 275 or less) contiguous nucleotides of SEQ ID NO: 8. Preferably, the adenovirus or adenoviral vector comprises a nucleic acid sequence comprising 121 to 300 contiguous nucleotides (e.g., 125, 150, 175, 200, 250, or 275 contiguous nucleotides), 121 to 200 contiguous nucleotides (e.g., 130, 140, 145, 160, 165, 170, 180, 185, 190, 195, or 199 contiguous nucleotides), or 121 to 150 contiguous nucleotides (e.g., 122, 123, 124, 125, 126, 127, 128, 129, 130, 131, 132, 133, 134, 135, 136, 137, 138, 139, 140, 141, 142, 143, 144, 145, 146, 147, 148, or 149 contiguous nucleotides) of SEQ ID NO: 8, or a range defined by any two of the foregoing values.

The adenovirus or adenoviral vector can comprise a nucleic acid sequence comprising at least 531 (e.g., 540 or more, 600 or more, 700 or more, 800 or more, 900 or more, or 1,000 or more) contiguous nucleotides of SEQ ID NO: 9, but no more than 3168 (e.g., 3,100 or less, 3,000 or less, 2,500 or less, 2,000 or less, or 1,500 or less) contiguous nucleotides of SEQ ID NO: 9. Preferably, the adenovirus or adenoviral vector comprises a nucleic acid sequence comprising 531 to 2,000 contiguous nucleotides (e.g., 550, 600, 700, 1,000, 1,200, 1,500, or 1,700 contiguous nucleotides), 531 to 1,000 contiguous nucleotides (e.g., 535, 575, 600, 650, 675, 725, 750, 800, 850, 900, or 950 contiguous nucleotides), or 531 to 800 contiguous nucleotides (e.g., 540, 545, 550, 560, 565, 570, 580, 585, 590, 595, 615, 625, 630, 640, 660, 665, 670, 680, 685, 690, 695, 705, 715, 730, 740, 755, 760, 765, 770, 775, 780, 785, 790, 795, or 799 contiguous nucleotides) of SEQ ID NO: 9, or a range defined by any two of the foregoing values.

The adenovirus or adenoviral vector can comprise a nucleic acid sequence comprising at least 156 (e.g., 160 or more, 200 or more, 225 or more, 235 or more, 250 or more, 300 or more, 350 or more, 400 or more, 450 or more, or 500 or more) contiguous nucleotides of SEQ ID NO: 10, but no more than 1,863 (e.g., 1,800 or less, 1,500 or less, 1,200 or less, 1,000 or less, 850 or less, 800 or less, 750 or less, or 700 or less) contiguous nucleotides of SEQ ID NO: 10. Preferably, the adenovirus or adenoviral vector comprises a nucleic acid sequence comprising 156 to 1,500 contiguous nucleotides (e.g., 175, 210, 225, 245, 255, 265, 275, 290, 300, 400, 500, 600, 700, 800, 900, 1,000, or 1,200 contiguous nucleotides), 156 to 1,000 contiguous nucleotides (e.g., 165, 180, 185, 195, 205, 230, 240, 260, 270, 295, 350, 450, 550, 650, 750, 850, or 950 contiguous nucleotides), or 156 to 500 contiguous nucleotides (e.g., 199, 230, 235, 290, 305, 310, 315, 325, 340, 345, 360, 365, 370, 375, 380, 385, 390, 395, 405, 425, 430, 440, 455, 460, 465, 470, 475, 480, 485, 490, 495, or 499 contiguous nucleotides) of SEQ ID NO: 10, or a range defined by any two of the foregoing values.

The adenovirus or adenoviral vector can comprise a nucleic acid sequence comprising at least 192 (e.g., 200 or more, 300 or more, 400 or more, 500 or more, or 600 or more) contiguous nucleotides of SEQ ID NO: 11, but no more than 2841 (2,800 or less, 2,500 or less, 2,000 or less, 1,800 or less, or 1,500 or less) contiguous nucleotides of SEQ ID NO: 11. Preferably, the adenovirus or adenoviral vector comprises a nucleic acid sequence comprising 192 to 2,000 contiguous nucleotides (e.g., 200, 250, 300, 350, 400, 450, 500, 550, 600, 650, 700, 800, 900, 1,000, 1,200, 1,500, 1,700, or 1,900 contiguous nucleotides), 192 to 1,000 contiguous nucleotides (e.g., 275, 375, 475, 575, 675, 775, 875, or 975 contiguous nucleotides), or 192 to 500 contiguous nucleotides (e.g., 220, 235, 240, 255, 260, 270, 280, 285, 290, 295, 299, 305, 315, 330, 335, 340, 345, 355, 360, 365, 370, 385, 390, 395, 399, 405, 415, 430, 435, 440, 445, 455, 460, 465, 470, 485, 490, 495, 499 contiguous nucleotides) of SEQ ID NO: 11, or a range defined by any two of the foregoing values.

The adenovirus or adenoviral vector can comprise a nucleic acid sequence comprising at least 84 (e.g., 90 or more, 100 or more, 200 or more, 300 or more, 500 or more, 700 or more, or 900 or more) contiguous nucleotides of SEQ ID NO: 12, but no more than 1,740 (1,700 or less, 1,500 or less, 1,200 or less, or 1,000 or less) contiguous nucleotides of SEQ ID NO: 12. Preferably, the adenovirus or adenoviral vector comprises a nucleic acid sequence comprising 84 to 1,200 contiguous nucleotides (e.g., 95, 100, 200, 400, 600, 800, 1,000, or 1,200 contiguous nucleotides), 84 to 1,000 contiguous nucleotides (e.g., 95, 150, 195, 250, 350, 450, 550, 650, 750, 850, or 950 contiguous nucleotides), or 84 to 500 contiguous nucleotides (e.g., 90, 99, 115, 125, 130, 145, 155, 165, 175, 190, 225, 230, 240, 255, 260, 265, 270, 275, 315, 325, 330, 340, 355, 360, 365, 370, 375, 380, 385, 390, 395, 415, 425, 430, 440, 455, 460, 465, 470, 475, 480, 485, 490, 495, or 499 contiguous nucleotides) of SEQ ID NO: 12, or a range defined by any two of the foregoing values.

The adenovirus or adenoviral vector can comprise one, two, three, four, five, six, or all seven of the aforementioned sequences alone, or in any combination. In this respect, the adenovirus or adenoviral vector can comprise any combination of any two of the aforementioned sequences, any combination of any three of the aforementioned sequences, any combination of any four of the aforementioned sequences, any combination of any five of the aforementioned sequences, any combination of any six of the aforementioned sequences, or all seven of the aforementioned sequences. For example, the adenovirus or adenoviral vector can comprise a nucleic acid sequence comprising at least 162 contiguous nucleotides of SEQ ID NO: 6. The adenovirus or adenoviral vector can comprise a nucleic acid sequence comprising at least 121 contiguous nucleotides of SEQ ID NO: 8, a nucleic acid sequence comprising at least 156 contiguous nucleotides of SEQ ID NO: 10, and a nucleic acid sequence comprising at least 84 contiguous nucleotides of SEQ ID NO: 12. The adenovirus or adenoviral vector can comprise a nucleic acid sequence comprising at least 162 contiguous nucleotides of SEQ ID NO: 7, a nucleic acid sequence comprising at least 531 contiguous nucleotides of SEQ ID NO: 9, and a nucleic acid sequence comprising at least 192 contiguous nucleotides of SEQ ID NO: 11. The adenovirus or adenoviral vector can comprise a nucleic acid sequence comprising at least 121 contiguous nucleotides of SEQ ID NO: 8, and a nucleic acid sequence comprising at least 531 contiguous nucleotides of SEQ ID NO: 9. The adenovirus or adenoviral vector can comprise (a) a nucleic acid sequence comprising at least 162 contiguous nucleotides of SEQ ID NO: 6 or SEQ ID NO: 7, (b) a nucleic acid sequence comprising at least 531 contiguous nucleotides of SEQ ID NO: 9, (c) a nucleic acid sequence comprising at least 156 contiguous nucleotides of SEQ ID NO: 10, (d) a nucleic acid sequence comprising at least 192 contiguous nucleotides of SEQ ID NO: 11, and (e) a nucleic acid sequence comprising at least 84 contiguous nucleotides of SEQ ID NO: 12.

In another embodiment, the adenovirus or adenoviral vector comprises one or more of the following amino acid sequences: (a) an amino acid sequence that is at least 85% identical (e.g., at least 91.67%, at least 98.33%, or 100% identical) to SEQ ID NO: 14, (b) an amino acid sequence that is at least 80% identical (e.g., at least 86.25%, at least 92.50%, at least 98.75%, or 100% identical) to SEQ ID NO: 15, and (c) an amino acid sequence that is at least 80% identical (e.g., at least 80.25%, at least 86.50%, at least 92.75%, at least 99.00%, or 100% identical) to SEQ ID NO: 16.

The adenovirus or adenoviral vector can comprise one, two, or all three of the aforementioned amino acid sequences alone or in any combination. In this respect, the adenovirus or adenoviral vector can comprise one of the aforementioned sequences, any combination of any two of the aforementioned sequences, or all three of the aforementioned sequences. For example, the adenovirus or adenoviral vector can comprise an amino acid sequence that is at least 85% identical to SEQ ID NO: 14. The adenovirus or adenoviral vector can comprise an amino acid sequence that is at least 85% identical to SEQ ID NO: 14, and an amino acid sequence that is at least 80% identical to SEQ ID NO: 15. The adenovirus or adenoviral vector can comprise (a) an amino acid sequence that is at least 85% identical to SEQ ID NO: 14, (b) an amino acid sequence that is at least 80% identical to SEQ ID NO: 15, and (c) an amino acid sequence that is at least 80% identical to SEQ ID NO: 16. The adenovirus or adenoviral vector can comprise (a) the amino acid sequence of SEQ ID NO: 14, (b) the amino acid sequence of SEQ ID NO: 15, or (c) the amino acid sequence of SEQ ID NO: 16. The adenovirus or adenoviral vector can comprise (a) the amino acid sequence of SEQ ID NO: 14, (b) the amino acid sequence of SEQ ID NO: 15, and (c) the amino acid sequence of SEQ ID NO: 16.

In another embodiment, the adenovirus or adenoviral vector comprises one or more of the following amino acid sequences: (a) an amino acid sequence that is at least 99% identical (e.g., at least 99% or 100% identical) to SEQ ID NO: 18, (b) an amino acid sequence that is at least 81.4% identical (e.g., at least 81.56%, at least 81.72%, at least 81.88%, at least 82.04%, at least 82.21%, at least 82.37%, at least 82.53%, at least 82.69%, at least 82.85%, at least 83.01%, at least 83.17%, at least 83.33%, at least 83.49%, at least 83.65%, at least 83.82%, at least 83.98%, at least 84.14%, at least 84.30%, at least 84.46%, at least 84.62%, at least 84.78%, at least 84.94%, at least 85.10%, at least 85.26%, at least 85.43%, at least 85.59%, at least 85.75%, at least 85.91%, at least 86.07%, at least 86.23%, at least 86.39%, at least 86.55%, at least 86.71%, at least 86.88%, at least 87.04%, at least 87.20%, at least 87.36%, at least 87.52%, at least 87.68%, at least 87.84%, at least 88.00%, at least 88.16%, at least 88.32%, at least 88.49%, at least 88.65%, at least 88.81%, at least 88.97%, at least 89.13%, at least 89.29%, at least 89.45%, at least 89.61%, at least 89.77%, at least 89.93%, at least 90.10%, at least 90.26%, at least 90.42%, at least 90.58%, at least 90.74%, at least 90.90%, at least 91.06%, at least 91.22%, at least 91.38%, at least 91.54%, at least 91.71%, at least 91.87%, at least 92.03%, at least 92.19%, at least 92.35%, at least 92.51%, at least 92.67%, at least 92.83%, at least 92.99%, at least 93.16%, at least 93.32%, at least 93.48%, at least 93.64%, at least 93.80%, at least 93.96%, at least 94.12%, at least 94.28%, at least 94.44%, at least 94.60%, at least 94.77%, at least 94.93%, at least 95.09%, at least 95.25%, at least 95.41%, at least 95.57%, at least 95.73%, at least 95.89%, at least 96.05%, at least 96.21%, at least 96.38%, at least 96.54%, at least 96.70%, at least 96.86%, at least 97.02%, at least 97.18%, at least 97.34%, at least 97.50%, at least 97.66%, at least 97.83%, at least 97.99%, at least 98.15%, at least 98.31%, at least 98.47%, at least 98.63%, at least 98.79%, at least 98.95%, at least 99.11%, at least 99.27%, at least 99.44%, at least 99.60%, at least 99.76%, at least 99.92%, or 100% identical to) to SEQ ID NO: 20, (c) an amino acid sequence that is at least 91.3% identical (e.g., at least 91.41%, at least 91.51%, at least 91.62%, at least 91.72%, at least 91.83%, at least 91.93%, at least 92.04%, at least 92.14%, at least 92.25%, at least 92.36%, at least 92.46%, at least 92.57%, at least 92.67%, at least 92.78%, at least 92.88%, at least 92.99%, at least 93.10%, at least 93.20%, at least 93.31%, at least 93.41%, at least 93.52%, at least 93.62%, at least 93.73%, at least 93.83%, at least 93.94%, at least 94.05%, at least 94.15%, at least 94.26%, at least 94.36%, at least 94.47%, at least 94.57%, at least 94.68%, at least 94.78%, at least 94.89%, at least 95.00%, at least 95.10%, at least 95.21%, at least 95.31%, at least 95.42%, at least 95.52%, at least 95.63%, at least 95.74%, at least 95.84%, at least 95.95%, at least 96.05%, at least 96.16%, at least 96.26%, at least 96.37%, at least 96.47%, at least 96.58%, at least 96.69%, at least 96.79%, at least 96.90%, at least 97.00%, at least 97.11%, at least 97.21%, at least 97.32%, at least 97.42%, at least 97.53%, at least 97.64%, at least 97.74%, at least 97.85%, at least 97.95%, at least 98.06%, at least 98.16%, at least 98.27%, at least 98.37%, at least 98.48%, at least 98.59%, at least 98.69%, at least 98.80%, at least 98.90%, at least 99.01%, at least 99.11%, at least 99.22%, at least 99.33%, at least 99.43%, at least 99.54%, at least 99.64%, at least 99.75%, at least 99.85%, at least 99.96%, or 100% identical) to SEQ ID NO: 21, and (d) an amino acid sequence that is at least 83.4% identical (e.g., at least 83.57%, at least 83.74%, at least 83.92%, at least 84.09%, at least 84.26%, at least 84.43%, at least 84.61%, at least 84.78%, at least 84.95%, at least 85.12%, at least 85.30%, at least 85.47%, at least 85.64%, at least 85.81%, at least 85.99%, at least 86.16%, at least 86.33%, at least 86.50%, at least 86.68%, at least 86.85%, at least 87.02%, at least 87.19%, at least 87.37%, at least 87.54%, at least 87.71%, at least 87.88%, at least 88.06%, at least 88.23%, at least 88.40%, at least 88.57%, at least 88.74%, at least 88.92%, at least 89.09%, at least 89.26%, at least 89.43%, at least 89.61%, at least 89.78%, at least 89.95%, at least 90.12%, at least 90.30%, at least 90.47%, at least 90.64%, at least 90.81%, at least 90.99%, at least 91.16%, at least 91.33%, at least 91.50%, at least 91.68%, at least 91.85%, at least 92.02%, at least 92.19%, at least 92.37%, at least 92.54%, at least 92.71%, at least 92.88%, at least 93.06%, at least 93.23%, at least 93.40%, at least 93.57%, at least 93.74%, at least 93.92%, at least 94.09%, at least 94.26%, at least 94.43%, at least 94.61%, at least 94.78%, at least 94.95%, at least 95.12%, at least 95.30%, at least 95.47%, at least 95.64%, at least 95.81%, at least 95.99%, at least 96.16%, 96.33%, at least 96.50%, at least 96.68%, at least 96.85%, at least 97.02%, at least 97.19%, at least 97.37%, at least 97.54%, at least 97.71%, at least 97.88%, at least 98.06%, at least 98.23%, at least 98.40%, at least 98.57%, at least 98.74%, at least 98.92%, at least 99.09%, at least 99.26%, at least 99.43%, at least 99.61%, at least 99.78%, at least 99.95%, or 100% identical) to SEQ ID NO: 22.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence that is at least 99% identical to SEQ ID NO: 18. The adenovirus or adenoviral vector can comprise an amino acid sequence that is at least 99% identical to SEQ ID NO: 18, and an amino acid sequence that is at least 91.3% identical to SEQ ID NO: 21. The adenovirus or adenoviral vector can comprise an amino acid sequence that is at least 99% identical to SEQ ID NO: 18, an amino acid sequence that is at least 81.4% identical to SEQ ID NO: 20, and an amino acid sequence that is at least 91.3% identical to SEQ ID NO: 21. The adenovirus or adenoviral vector can comprise (a) the amino acid sequence of SEQ ID NO: 18, (b) the amino acid sequence of SEQ ID NO: 20, (c) the amino acid sequence of SEQ ID NO: 21, or (d) the amino acid sequence of SEQ ID NO: 22. The adenovirus or adenoviral vector can comprise (a) an amino acid sequence that is at least 99% identical to SEQ ID NO: 18, (b) an amino acid sequence that is at least 81.4% identical to SEQ ID NO: 20, (c) an amino acid sequence that is at least 91.3% identical to SEQ ID NO: 21, and (d) an amino acid sequence that is at least 83.4% identical to SEQ ID NO: 22. The adenovirus or adenoviral vector can comprise (a) the amino acid sequence of SEQ ID NO: 18, (b) the amino acid sequence of SEQ ID NO: 20, (c) the amino acid sequence of SEQ ID NO: 21, and (d) the amino acid sequence of SEQ ID NO: 22.

In another embodiment, the adenovirus or adenoviral vector comprises one or more of the following amino acid sequences: (a) an amino acid sequence comprising at least 89 contiguous amino acid residues of SEQ ID NO: 18, (b) an amino acid sequence comprising at least 114 contiguous amino acid residues of SEQ ID NO: 20, (c) an amino acid sequence comprising at least 231 contiguous amino acid residues of SEQ ID NO: 21, and (d) an amino acid sequence comprising at least 30 contiguous amino acid residues of SEQ ID NO: 22.

The adenovirus or adenoviral vector can comprise an amino acid sequence comprising at least 89 (e.g., 90 or more, 100 or more, or 110 or more) contiguous amino acid residues of SEQ ID NO: 18, but no more than 133 (e.g., 130 or less, 125 or less, 120 or less, or 115 or less) contiguous amino acid residues of SEQ ID NO: 18. Preferably, the adenovirus or adenoviral vector comprises an amino acid sequence comprising 89 to 130 contiguous amino acid residues (e.g., 90, 100, 110, 115, 120, or 125 contiguous amino acid residues) of SEQ ID NO: 18, 89 to 115 contiguous amino acid residues of SEQ ID NO: 18 (e.g., 95, 110, or 112 contiguous amino acid residues), or 89 to 100 contiguous amino acid residues (e.g., 89, 90, 91, 92, 93, 94, 95, 96, 97, 98, or 99 contiguous amino acid residues) of SEQ ID NO: 18, or a range defined by any two of the foregoing values.

The adenovirus or adenoviral vector can comprise an amino acid sequence comprising at least 114 (e.g., 125 or more, 150 or more, 175 or more, 200 or more, 250 or more 250 or more, 275 or more, 300 or more, or 400 or more) contiguous amino acid residues of SEQ ID NO: 20, but no more than 621 (e.g., 620 or less, 600 or less, 550 or less, or 450 or less) contiguous amino acid residues of SEQ ID NO: 20. Preferably, the adenovirus or adenoviral vector comprises an acid sequence comprising 114 to 600 contiguous amino acid residues (e.g., 155, 180, 200, 250, 275, 300, 400, or 500 contiguous amino acid residues) of SEQ ID NO: 20, 114 to 500 contiguous amino acid residues of SEQ ID NO: 20 (e.g., 130, 160, 190, 220, 250, 280, 310, 340, 370, 375, 400, 425, 450, or 475 contiguous amino acid residues), or 114 to 300 contiguous amino acid residues (e.g., 165, 175, 185, 195, 199, 15, 225, 235, 245, 255, 265, 285, 295, 299, 315, 325, 335, 345, 355, 360, 365, 380, 385, 390, 395, or 399 contiguous amino acid residues) of SEQ ID NO: 20, or a range defined by any two of the foregoing values.

The adenovirus or adenoviral vector can comprise an amino acid sequence comprising at least 231 (e.g., 250 or more, 300 or more, 400 or more, or 500 or more) contiguous amino acid residues of SEQ ID NO: 21, but no more than 947 (e.g., 940 or less, 900 or less, 800 or less, 700 or less, or 600 or less) contiguous amino acid residues of SEQ ID NO: 21. Preferably, the adenovirus or adenoviral vector comprises an acid sequence comprising 231 to 800 contiguous amino acid residues (e.g., 250, 275, 290, 325, 350, 375, 390, 400, 500, 600, or 700 contiguous amino acid residues) of SEQ ID NO: 21, 231 to 600 contiguous amino acid residues (e.g., 235, 260, 285, 300, 335, 360, 375, 385, 395, 425, 445, 450, 465, 475, 525, 545, 550, 565 or 575 contiguous amino acid residues) of SEQ ID NO: 21, or 231 to 400 contiguous amino acid residues (e.g., 245, 255, 265, 285, 295, 299, 315, 345, 355, 365, 385, 389, 395, or 399 contiguous amino acid residues) of SEQ ID NO: 21, or a range defined by any two of the foregoing values.

The adenovirus or adenoviral vector can comprise an amino acid sequence comprising at least 30 (e.g., 50 or more, 75 or more, 100 or more, 200 or more, or 300 or more) contiguous amino acid residues of SEQ ID NO: 22, but no more than 580 (e.g., 575 or less, 550 or less, 500 or less, 450 or less, or 400 or less) contiguous amino acid residues of SEQ ID NO: 22. Preferably, the adenovirus or adenoviral vector comprises an acid sequence comprising 30 to 500 contiguous amino acid residues (e.g., 35, 55, 85, 105, 135, 155, 175, 195, 200, 205, 235, 250, 275, 295, 300, 305, 335, 350, 375, 395, 400, 405, 435, 450, 475, 495, or 499 contiguous amino acid residues) of SEQ ID NO: 22, 30 to 300 contiguous amino acid residues (e.g., 40, 60, 70, 90, 125, 140, 160, 170, 180, 190, 200, 210, 220, 230, 240, 250, 260, 270, 280, or 290 contiguous amino acid residues) of SEQ ID NO: 22, or 30 to 100 contiguous amino acid residues (e.g., 33, 34, 39, 42, 43, 44, 49, 52, 58, 59, 62, 68, 69, 72, 78, 79, 81, 84, 87, 88, 91, 92, 93, 94, 97, 98, or 99 contiguous amino acid residues) of SEQ ID NO: 22, or a range defined by any two of the foregoing values.

The adenovirus or adenoviral vector can comprise one, two, three, or all four of the aforementioned amino acid sequences alone or in any combination. In this respect, the adenovirus or adenoviral vector can comprise any combination of any two of the aforementioned sequences, any combination of any three of the aforementioned sequences, or all four of the aforementioned sequences. For example, the adenovirus or adenoviral vector can comprise an amino acid sequence comprising at least 89 contiguous amino acid residues of SEQ ID NO: 18. The adenovirus or adenoviral vector can comprise an amino acid sequence comprising at least 89 contiguous amino acid residues of SEQ ID NO: 18, and an amino acid sequence comprising at least 114 contiguous amino acid residues of SEQ ID NO: 20. The adenovirus or adenoviral vector can comprise (a) an amino acid sequence comprising at least 89 contiguous amino acid residues of SEQ ID NO: 18, (b) an amino acid sequence comprising at least 231 contiguous amino acid residues of SEQ ID NO: 21, and (c) an amino acid sequence comprising at least 30 contiguous amino acid residues of SEQ ID NO: 22. The adenovirus or adenoviral vector can comprise (a) an amino acid sequence comprising at least 114 contiguous amino acid residues of SEQ ID NO: 20, (b) an amino acid sequence comprising at least 231 contiguous amino acid residues of SEQ ID NO: 21, and (c) an amino acid sequence comprising at least 30 contiguous amino acid residues of SEQ ID NO: 22. The adenovirus or adenoviral vector can comprise (a) an amino acid sequence comprising at least 89 contiguous amino acid residues of SEQ ID NO: 18, (b) an amino acid sequence comprising at least 114 contiguous amino acid residues of SEQ ID NO: 20, (c) an amino acid sequence comprising at least 231 contiguous amino acid residues of SEQ ID NO: 21, and (d) an amino acid sequence comprising at least 30 contiguous amino acid residues of SEQ ID NO: 22.

In other embodiments, the adenovirus or adenoviral vector comprises one or more nucleic acid sequences that encode one or more of any of the aforementioned amino acid sequences, e.g., the amino acid sequences of any of SEQ ID NOs: 13-22 or any of the variants and/or portions thereof as described herein. For example, the adenovirus or adenoviral vector can comprise a nucleic acid sequence encoding an amino acid sequence that is at least 99.75% identical (e.g., at least 99.84%, at least 99.94%, or 100% identical) to SEQ ID NO: 19, or a nucleic acid sequence encoding an amino acid sequence that is at least 99.7% identical (e.g., at least 99.93% or 100% identical) to SEQ ID NO: 13.

The adenovirus or adenoviral vector can comprise the nucleic acid sequence of, for example, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, or SEQ ID NO: 36.

As discussed herein, the adenovirus or adenoviral vector can be replication-competent, conditionally-replicating, or replication-deficient. Preferably, the adenovirus or adenoviral vector is replication-deficient, such that the replication-deficient adenovirus or adenoviral vector requires complementation of at least one replication-essential gene function of one or more regions of the adenoviral genome for propagation (e.g., to form adenoviral vector particles).

The replication-deficient adenovirus or adenoviral vector can be modified in any suitable manner to cause the deficiencies in the one or more replication-essential gene functions in one or more regions of the adenoviral genome for propagation. The complementation of the deficiencies in the one or more replication-essential gene functions of one or more regions of the adenoviral genome refers to the use of exogenous means to provide the deficient replication-essential gene functions. Such complementation can be effected in any suitable manner, for example, by using complementing cells and/or exogenous DNA (e.g., helper adenovirus) encoding the disrupted replication-essential gene functions.

The adenovirus or adenoviral vector can be deficient in one or more replication-essential gene functions of only the early regions (i.e., E1-E4 regions) of the adenoviral genome, only the late regions (i.e., L1-L5 regions) of the adenoviral genome, both the early and late regions of the adenoviral genome, or all adenoviral genes (i.e., a high capacity adenovector (HC-Ad). See Morsy et al., *Proc. Natl. Acad. Sci. USA*, 95: 965-976 (1998); Chen et al., *Proc. Natl. Acad. Sci. USA*, 94: 1645-1650 (1997); and Kochanek et al., *Hum. Gene Ther.*, 10: 2451-2459 (1999). Examples of replication-deficient adenoviral vectors are disclosed in U.S. Pat. Nos. 5,837,511; 5,851,806; 5,994,106; 6,127,175; 6,482,616; and 7,195,896, and International Patent Application Publications WO 1994/028152, WO 1995/002697, WO 1995/016772, WO 1995/034671, WO 1996/022378, WO 1997/012986, WO 1997/021826, and WO 2003/022311.

The early regions of the adenoviral genome include the E1, E2, E3, and E4 regions. The E1 region comprises the E1A and E1B subregions, and one or more deficiencies in replication-essential gene functions in the E1 region can include one or more deficiencies in replication-essential gene functions in either or both of the E1A and E1B subregions, thereby requiring complementation of the E1A subregion and/or the E1B subregion of the adenoviral genome for the adenovirus or adenoviral vector to propagate (e.g., to form adenoviral vector particles). The E2 region comprises the E2A and E2B subregions, and one or more deficiencies in replication-essential gene functions in the E2 region can include one or more deficiencies in replication-essential gene functions in either or both of the E2A and E2B subregions, thereby requiring complementation of the E2A subregion and/or the E2B subregion of the adenoviral genome for the adenovirus or adenoviral vector to propagate (e.g., to form adenoviral vector particles).

The E3 region does not include any replication-essential gene functions, such that a deletion of the E3 region in part or in whole does not require complementation of any gene functions in the E3 region for the adenovirus or adenoviral vector to propagate (e.g., to form adenoviral vector particles). In the context of the invention, the E3 region is defined as the region that initiates with the open reading frame that encodes a protein with high homology to the 12.5K protein from the E3 region of human adenovirus 5 (NCBI reference sequence AP_000218) and ends with the open reading frame that encodes a protein with high homology to the 14.7K protein from the E3 region of human adenovirus 5 (NCBI reference sequence AP_000224.1). The E3 region may be deleted in whole or in part, or retained in whole or in part. The size of the deletion may be tailored so as to retain an adenovirus or adenoviral vector whose genome closely matches the optimum genome packaging size. A larger deletion will accommodate the insertion of larger heterologous nucleic acid sequences in the adenovirus or adenoviral genome. In one embodiment of the invention, the L4 polyadenylation signal sequences, which reside in the E3 region, are retained.

The E4 region comprises multiple open reading frames (ORFs). An adenovirus or adenoviral vector with a deletion of all of the open reading frames of the E4 region except ORF6, and in some cases ORF3, does not require complementation of any gene functions in the E4 region for the adenovirus or adenoviral vector to propagate (e.g., to form adenoviral vector particles). Conversely, an adenovirus or adenoviral vector with a disruption or deletion of ORF6, and in some cases ORF3, of the E4 region (e.g., with a deficiency in a replication-essential gene function based in ORF6 and/or ORF3 of the E4 region), with or without a disruption or deletion of any of the other open reading frames of the E4 region or the native E4 promoter, polyadenylation sequence, and/or the right-side inverted terminal repeat (ITR), requires complementation of the E4 region (specifically, of ORF6 and/or ORF3 of the E4 region) for the adenovirus or adenoviral vector to propagate (e.g., to form adenoviral vector particles). The late regions of the adenoviral genome include the L1, L2, L3, L4, and L5 regions. The adenovirus or adenoviral vector also can have a mutation in the major late promoter (MLP), as discussed in International Patent Application Publication WO 2000/000628, which can render the adenovirus or adenoviral vector replication-deficient if desired.

The one or more regions of the adenoviral genome that contain one or more deficiencies in replication-essential gene functions desirably are one or more early regions of the adenoviral genome, i.e., the E1, E2, and/or E4 regions, optionally with the deletion in part or in whole of the E3 region.

The replication-deficient adenovirus or adenoviral vector also can have one or more mutations as compared to the wild-type adenovirus (e.g., one or more deletions, insertions, and/or substitutions) in the adenoviral genome that do not inhibit viral replication in host cells. Thus, in addition to one or more deficiencies in replication-essential gene functions, the adenovirus or adenoviral vector can be deficient in other respects that are not replication-essential. For example, the adenovirus or adenoviral vector can have a partial or entire deletion of the adenoviral early region known as the E3 region, which is not essential for propagation of the adenovirus or adenoviral genome.

In one embodiment, the adenovirus or adenoviral vector is replication-deficient and requires, at most, complementation of the E1 region or the E4 region of the adenoviral genome, for propagation (e.g., to form adenoviral vector particles). Thus, the replication-deficient adenovirus or adenoviral vector requires complementation of at least one replication-essential gene function of the E1A subregion and/or the E1B region of the adenoviral genome (denoted an E1-deficient adenoviral vector) or the E4 region of the adenoviral genome (denoted an E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome and at least one gene function of the nonessential E3 region of the adenoviral genome (denoted an E1/E3-deficient adenoviral vector). The adenovirus or adenoviral vector can be deficient in at least one replication-essential gene function (desirably all replication-essential gene functions) of the E4 region of the adenoviral genome and at least one gene function of the nonessential E3 region of the adenoviral genome (denoted an E3/E4-deficient adenoviral vector).

In one embodiment, the adenovirus or adenoviral vector is replication-deficient and requires, at most, complementation of the E2 region, preferably the E2A subregion, of the adenoviral genome, for propagation (e.g., to form adenoviral vector particles). Thus, the replication-deficient adenovirus or adenoviral vector requires complementation of at least one replication-essential gene function of the E2A subregion of the adenoviral genome (denoted an E2A-deficient adenoviral vector) for propagation (e.g., to form adenoviral vector particles). The adenovirus or adenoviral vector can be deficient in at least one replication-essential gene function (desirably all replication-essential gene functions) of the E2A region of the adenoviral genome and at least one gene function of the nonessential E3 region of the adenoviral genome (denoted an E2A/E3-deficient adenoviral vector).

In one embodiment, the adenovirus or adenoviral vector is replication-deficient and requires, at most, complementation of the E1 and E4 regions of the adenoviral genome for propagation (e.g., to form adenoviral vector particles). Thus, the replication-deficient adenovirus or adenoviral vector requires complementation of at least one replication-essential gene function of both the E1 and E4 regions of the adenoviral genome (denoted an E1/E4-deficient adenoviral vector) for propagation (e.g., to form adenoviral vector particles). The adenovirus or adenoviral vector can be deficient in at least one replication-essential gene function (desirably all replication-essential gene functions) of the E1 region of the adenoviral genome, at least one replication-essential gene function of the E4 region of the adenoviral genome, and at least one gene function of the nonessential E3 region of the adenoviral genome (denoted an E1/E3/E4-deficient adenoviral vector). The adenovirus or adenoviral vector preferably requires, at most, complementation of the E1 region of the adenoviral genome for propagation, and does not require complementation of any other deficiency of the adenoviral genome for propagation. More preferably, the adenovirus or adenoviral vector requires, at most, complementation of the E1 and E4 regions of the adenoviral genome for propagation, and does not require complementation of any other deficiency of the adenoviral genome for propagation.

The adenovirus or adenoviral vector, when deficient in multiple replication-essential gene functions of the adenoviral genome (e.g., an E1/E4-deficient adenoviral vector), can include a spacer sequence to provide viral growth in a complementing cell line similar to that achieved by adenoviruses or adenoviral vectors deficient in a single replication-essential gene function (e.g., an E1-deficient adenoviral vector). The spacer sequence can contain any nucleotide sequence or sequences which are of a desired length, such as sequences at least about 15 base pairs (e.g., between about 15 nucleotides and about 12,000 nucleotides), preferably about 100 nucleotides to about 10,000 nucleotides, more preferably about 500 nucleotides to about 8,000 nucleotides, even more preferably about 1,500 nucleotides to about 6,000 nucleotides, and most preferably about 2,000 to about 3,000 nucleotides in length, or a range defined by any two of the foregoing values. The spacer sequence can be coding or non-coding and native or non-native with respect to the adenoviral genome, but does not restore the replication-essential function to the deficient region. The spacer also can contain an expression cassette. More preferably, the spacer comprises a polyadenylation sequence and/or a gene that is non-native with respect to the adenovirus or adenoviral vector. The use of a spacer in an adenoviral vector is further described in, for example, U.S. Pat. No. 5,851,806 and International Patent Application Publication WO 1997/021826.

By removing all or part of the adenoviral genome, for example, the E1, E3, and E4 regions of the adenoviral genome, the resulting adenovirus or adenoviral vector is able to accept inserts of exogenous nucleic acid sequences while retaining the ability to be packaged into adenoviral capsids. An exogenous nucleic acid sequence can be inserted at any position in the adenoviral genome so long as insertion in the position allows for the formation of adenovirus or the adenoviral vector particle. The exogenous nucleic acid sequence preferably is positioned in the E1 region, the E3 region, or the E4 region of the adenoviral genome.

The replication-deficient adenovirus or adenoviral vector of the invention can be produced in complementing cell lines that provide gene functions not present in the replication-deficient adenovirus or adenoviral vector, but required for viral propagation, at appropriate levels in order to generate high titers of viral vector stock. Such complementing cell lines are known and include, but are not limited to, 293 cells (described in, e.g., Graham et al., *J. Gen. Virol.*, 36: 59-72 (1977)), PER.C6 cells (described in, e.g., International Patent Application Publication WO 1997/000326, and U.S. Pat. Nos. 5,994,128 and 6,033,908), and 293-ORF6 cells (described in, e.g., International Patent Application Publication WO 95/34671 and Brough et al., *J. Virol.*, 71: 9206-9213 (1997)). Other suitable complementing cell lines to produce the replication-deficient adenovirus or adenoviral vector of the invention include complementing cells that have been generated to propagate adenoviral vectors encoding transgenes whose expression inhibits viral growth in host cells (see, e.g., U.S. Patent Application Publication No. 2008/0233650). Additional suitable complementing cells are described in, for example, U.S. Pat. Nos. 6,677,156 and 6,682,929, and International Patent Application Publication WO 2003/020879. In some instances, the cellular genome need not comprise nucleic acid sequences, the gene products of which complement for all of the deficiencies of a replication-deficient adenoviral vector. One or more replication-essential gene functions lacking in a replication-deficient adenoviral vector can be supplied by a helper virus, e.g., an adenoviral vector that supplies in trans one or more essential gene functions required for replication of the replication-deficient adenovirus or adenoviral vector. Alternatively, the inventive adenovirus or adenoviral vector can comprise a non-native replication-essential gene that complements for the one or more replication-essential gene functions lacking in the inventive replication-deficient adenovirus or adenoviral vector. For example, an E1/E4-deficient adenoviral vector can be engineered to contain a nucleic acid sequence encoding E4 ORF 6 that is obtained or derived from a different adenovirus (e.g., an adenovirus of a different serotype than the inventive adenovirus or adenoviral vector, or an adenovirus of a different species than the inventive adenovirus or adenoviral vector).

The adenovirus or adenoviral vector can further comprise a transgene. The term "transgene" is defined herein as a non-native nucleic acid sequence that is operably linked to appropriate regulatory elements (e.g., a promoter), such that the non-native nucleic acid sequence can be expressed to produce a protein (e.g., peptide or polypeptide). The regulatory elements (e.g., promoter) can be native or non-native to the adenovirus or adenoviral vector.

A "non-native" nucleic acid sequence is any nucleic acid sequence (e.g., DNA, RNA, or cDNA sequence) that is not a naturally occurring nucleic acid sequence of an adenovirus in a naturally occurring position. Thus, the non-native nucleic acid sequence can be naturally found in an adenovirus, but located at a non-native position within the adenoviral genome and/or operably linked to a non-native promoter. The terms "non-native nucleic acid sequence," "heterologous nucleic acid sequence," and "exogenous nucleic acid sequence" are synonymous and can be used interchangeably in the context of the invention. The non-native nucleic acid sequence preferably is DNA and preferably encodes a protein (i.e., one or more nucleic acid sequences encoding one or more proteins).

The non-native nucleic acid sequence can encode a therapeutic protein that can be used to prophylactically or therapeutically treat a mammal for a disease. Examples of suitable therapeutic proteins include cytokines, toxins, tumor suppressor proteins, growth factors, hormones, receptors, mitogens, immunoglobulins, neuropeptides, neurotransmitters, and enzymes. Alternatively, the non-native nucleic acid sequence can encode an antigen of a pathogen (e.g., a bacterium or a virus), and the adenovirus or adenoviral vector can be used as a vaccine.

The invention provides a composition comprising the adenovirus or adenoviral vector described herein and a carrier therefor (e.g., a pharmaceutically acceptable carrier). The composition desirably is a physiologically acceptable (e.g., pharmaceutically acceptable) composition, which comprises a carrier, preferably a physiologically (e.g., pharmaceutically) acceptable carrier, and the adenovirus or adenoviral vector. Any suitable carrier can be used within the context of the invention, and such carriers are well known in the art. The choice of carrier will be determined, in part, by the particular use of the composition (e.g., administration to an animal) and the particular method used to administer the composition. Ideally, in the context of replication-deficient adenoviral vectors, the pharmaceutical composition preferably is free of replication-competent adenovirus. The pharmaceutical composition optionally can be sterile.

Suitable compositions include aqueous and non-aqueous isotonic sterile solutions, which can contain anti-oxidants, buffers, and bacteriostats, and aqueous and non-aqueous sterile suspensions that can include suspending agents, solubilizers, thickening agents, stabilizers, and preservatives. The composition can be presented in unit-dose or multi-dose sealed containers, such as ampules and vials, and can be stored in a freeze-dried (lyophilized) condition requiring only the addition of the sterile liquid carrier, for example, water, immediately prior to use. Extemporaneous solutions and suspensions can be prepared from sterile powders, granules, and tablets. Preferably, the carrier is a buffered saline solution. More preferably, the adenovirus or adenoviral vector is part of a composition formulated to protect the adenovirus or adenoviral vector from damage prior to administration. For example, the composition can be formulated to reduce loss of the adenovirus or adenoviral vector on devices used to prepare, store, or administer the adenovirus or adenoviral vector, such as glassware, syringes, or needles. The composition can be formulated to decrease the light sensitivity and/or temperature sensitivity of the adenovirus or adenoviral vector. To this end, the composition preferably comprises a pharmaceutically acceptable liquid carrier, such as, for example, those described above, and a stabilizing agent selected from the group consisting of polysorbate 80, L-arginine, polyvinylpyrrolidone, trehalose, and combinations thereof. Use of such a composition will extend the shelf life of the adenovirus or adenoviral vector, and facilitate its administration. Formulations for adenovirus or adenoviral vector-containing compositions are further described in, for example, U.S. Pat. No. 6,225,289, U.S. Pat. No. 6,514,943, and International Patent Application Publication WO 2000/034444.

The composition also can be formulated to enhance transduction efficiency. In addition, one of ordinary skill in the art will appreciate that the adenovirus or adenoviral vector can be present in a composition with other therapeutic or biologically-active agents. For example, factors that control inflammation, such as ibuprofen or steroids, can be part of the composition to reduce swelling and inflammation associated with in vivo administration of the adenovirus or adenoviral vector. If the adenovirus or adenoviral vector is used to deliver an antigen-encoding nucleic acid sequence to a host, immune system stimulators or adjuvants, e.g., interleukins, lipopolysaccharide, or double-stranded RNA, can be administered to enhance or modify any immune response to the antigen. Antibiotics, i.e., microbicides and fungicides, can be present to treat existing infection and/or reduce the risk of future infection, such as infection associated with gene transfer procedures.

The following examples further illustrate the present invention and, of course, should not be construed as in any way limiting its scope.

Example 1

This example demonstrates the immunogenicity of an adenoviral vector encoding a Respiratory Syncytial Virus (RSV) F protein in cotton rats.

A gorilla adenovirus having the nucleic acid sequence of SEQ ID NO: 28 was modified by genetic engineering to (1) be rendered replication-deficient by deletion of the E1 region, and (2) express the human Respiratory Syncytial Virus (RSV) Fusion (F) glycoprotein. Because RSV replicates in the cytoplasm of cells, the gene encoding the F protein was modified for expression in a cell nucleus by removing RNA processing signals (e.g., RNA splicing sites), and was codon-optimized for expression in a mammalian cell. The expression of the F protein from the adenoviral vector was verified by infection of HEK-293 cells in vitro, and by a Western blot assay using protein extracts of the infected cells and a commercially available anti-RSV polyclonal antibody (Pab7133P, Maine Biotechnology, Portland, Me.).

Cotton rats (*Sigmodon hispidus*) were injected in the tibialis muscle with a single administration of $10^7$ particle units (pu) of the E1-deleted adenoviral vector expressing the RSV F glycoprotein. The animals were then challenged 28 days later with live human RSV ($10^6$ particle forming units (pfu) administered intranasally). At 5 days post-challenge, the viral load of RSV in the lungs of the animals was measured. The animals that were immunized with the adenoviral vector expressing the F protein did not have detectable RSV in the lungs (limit of detection 70 pfu/gram of lung tissue).

The results of this example demonstrate that the inventive adenoviral vector encoding an RSV F protein is immunogenic in vivo and can confer complete protection against RSV infection in cotton rats.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (36 sequences)

SEQ ID NO: 1 - DNA, 28 bp, Gorilla beringei graueri
ccccgttctgccttcaaattcgtctaca

SEQ ID NO: 2 - DNA, 1284 bp, Gorilla beringei graueri
ccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctgatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctcaggacaggtgaacatcaaatcctcctcatttttagaaactgacaacctgagcgctgaggtcatgcccgccttcgagagggaatacttaccccagcagctggctctcgcagacagcgatgcggaagagagtgaagatgaaagggcgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggggacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgctt

SEQ ID NO: 3 - DNA, 45 bp, Gorilla beringei graueri
gaggcggcggcggtagcgaccgcagagccggagaccgtagaggag

SEQ ID NO: 4 - DNA, 48 bp, Gorilla beringei graueri
actaatactgctgaagcagccattgaaaatgaagaagagctggcggat

SEQ ID NO: 5 - DNA, 48 bp, Gorilla beringei graueri
tcatggaggtggacaaatggagactacgtggggcactattttaaaaca

SEQ ID NO: 6 - DNA, 399 bp, Gorilla beringei graueri
atgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccc

SEQ ID NO: 7 - DNA, 399 bp, Gorilla beringei graueri
atgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccc

SEQ ID NO: 8 - DNA, 399 bp, Gorilla beringei graueri
atgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccc

SEQ ID NO: 9 - DNA, 3168 bp, Gorilla beringei graueri
atggacagctccaatgtgcgcgatgtcgtcatcaaactccgcccgccgagcgccgagatctggacctgcggctctcgcggcgtggtggtctgctccaccatcgccctccaggagacagatgctggcggccagacaaccaaagtagaagaccaccagccacacgggaccccaggcgggggacttagattcccgctgcgcttcctcgtcagaggtcgccaggttcacctcgtgcaagatatacaacccgtgcagcgctgccagtactgcggtcgcttttacaaaagccagcacgagtgctcggcccgcagacgggacttctactttcaccacatcaacagccaatcctccaactggtggcgggagatccagttcttcccgatcggctctcatcctcgcacggagcgcctctttgtcacctacgatgtagagacctacacttggatgggagcctttggcaagcagctcgtgcccttcatgctggtcatgaaactggggggcgacgaggctctggtcgccgccgcgcgcgacctcgcccgagagctcagatgggacccctgggagaaagaccccctcaccttctactgcatcacccccgaaaagatggccgtggggcgacagttcagaaccttccgcgaccgcctgcagaccctcatggcccgcgacctctggcgatccttcctggcggccaaccctcacttgcaagactgggccctggaggagcacggcctggaatcgcccgaggagctcacctacgaggaactcaaaaagctcccctccatcaagggccagccccgctttttggagctctacatcgtgggccacaacataaacggctttgacgagatcgtcctggccgcccaggtcatcaacaaccgctcctcggtcccagggccctttcgcatcaccagaaacttcatgcctcgagcggggaagatcctcttcaatgacctcaccttctccctgcccaacccgcgctccaaaaagcgcacggactacaccctgtgggaacagggcggctgcgatgacacagacttcaaacatcaatacctcaaagtcatggtcagggacactttcgccctcacccacacctccctccgcaaggcggcgcaggcctacgcgctgcccgtggagaagggctgttgcccctaccaggccgtcaaccagttctacatgctaggctcttaccgttcggacacggacgggtttcccctccaagagtactggaaagaccgcgaagagttcgtcctcaaccgcgagctgtggaaaaagaagggggaggataagtatgacatcatccgcgagaccctcgactactgcgcgctcgacgtccaggtcaccgccgagctggtgcacaagctgcgcgagtcctacgcctccttcgtcagggactcggtgggcttgcaagaagcaagcttcaacgtcttccagcggcccaccatctcctccaactcccatgccatcttcaggcagatcgccttccgcgccgagcgcccccagcgcaccaacctcgggcccaacatgctggccccctcccacgagctctatgactacgtgcgcgccagcatccgcggggggcgctgctaccccacctacctcggcatcctcagggaacccctgtacgtgtatgacatctgcggcatgtacgcctccgcgctcacccaccccatgccctggggcccgcccctcaacccctacgagcgcgcgctcgccgcccgcgaatggcagcgggctctggacatgcaagcttgcaagatcgactactttgacccgcgcttgctccccggggtcttcaccatcgacgcggaccccccaaacgaggaccagctggaccccctaccccccttctgctcgcgcaagggcggccgcctctgctggaccaacgagcgcctgcgcggcgaggtcgccaccagcgtcgacatggtcaccctgcacaaccgaggctggagggtgcgcctgatcccagacgagcgcaccaccgtcttccccgagtggaagtgcgtggcccgcgagtacgtgcaactcaacatcgcggccaaggagcgagccgaccgcgacaaaaaccagaccctgcgctccatcgccaagctgctctccaacgccctctacgggtcgttcgccaccaagcttgacaacaaaaaaatagtgttttctgaccagatggacccaggtaccctcaaaggtatcacctcaggacaggtgaacatcaaatcctcctcatttttagaaactgacaacctgagcgctgaggtcatgcccgccttcgagagggaatacttaccccagcagctggctctcgcagacagcgatgcggaagagagtgaagatgaaagggcgcccacccccttttatacccccccgtcgggaacccccggtcacgtgtcctacacctacaagccaatcacttttctggacgcggaggagggggacatgtgcctgcacaccctggagaaggtggacccgctagtggacaacgaccgctacccctcccacgtggcctccttcgtcctggcctggacgcgggccttcgtctcagagtggtcagagtttctctacgaggaggacagaggcactccgctggaagacaggcccctgaagtcggtctacggggacacggacagcctcttcgtcaccgagaagggacaccgcctcatggagagccgaggtaagaaacgcatcaaaaagcatgggggcaacctggtttttgaccctgaccgcccggagctcacttggctggtggaatgcgagacggtctgcgcttcctgcggcgcggacgcctactccccagagtccgtgtttctcgctcccaagctctacgccctgaagagcctgcagtgcccctcgtgcggcgccacctccaagggaaagctccgcgccaaggggcacgccgccgagggtctcgactacgagaccatggtcaaatgctacctggccgacgcgcagggcgaagagcggcagcgattcagcaccagcagaaccagcctcaagcgcaccctggccagcgcccaacccggagcgcaccccttcaccgtgacccagaccaccctgacgaggaccctgcgcccatggaaggacatgactctggccccgctggacgcccatcggctggtgccctacagcgaaagccgccccaacccgcgaaacgaggagatctgctggatcgagatgccg

SEQ ID NO: 10 - DNA, 1863 bp, Gorilla beringei graueri
atgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttt

SEQ ID NO: 11 - DNA, 2841 bp, Gorilla beringei graueri
atggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacc

SEQ ID NO: 12 - DNA, 1740 bp, Gorilla beringei graueri
atgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaa

SEQ ID NO: 13 - protein, 429 aa, Gorilla beringei graueri
AFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCAS

SEQ ID NO: 14 - protein, 15 aa, Gorilla beringei graueri
EAAAVATAEPETVEE

SEQ ID NO: 15 - protein, 16 aa, Gorilla beringei graueri
TNTAEAAIENEEELAD

SEQ ID NO: 16 - protein, 16 aa, Gorilla beringei graueri
SWRWTNGDYVGHYFKT

SEQ ID NO: 17 - protein, 133 aa, Gorilla beringei graueri
MSDTGNSFDGSIFSPYLTVRMPHWAGVRQNVMGSNVDGRPVLPSNSSTMAYATVGGTPLDAATSAAASAAAATARSMATDLYSSLVASSAASRASARDEKLTALLLKLEDLTRELGQLTQQVSSLRESSLASP

SEQ ID NO: 18 - protein, 133 aa, Gorilla beringei graueri
MSDTGNSFDGSIFSPYLTVRMPHWAGVRQNVMGSNVDGRPVLPSNSSTMAYATVGGTPLDAATSAAASAAAATARSMATDLYSSLVASGAASRASARDEKLTALLLKLEDLTRELAQLTQQVSSLRESSLASP

SEQ ID NO: 19 - protein, 1056 aa, Gorilla beringei graueri
MDSSNVRDVVIKLRPPSAEIWTCGSRGVVVCSTIALQETDAGGQTTKVEDHQPHGTPGGGLRFPLRFLVRGRQVHLVQDIQPVQRCQYCGRFYKSQHECSARRRDFYFHHINSQSSNWWREIQFFPIGSHPRTERLFVTYDVETYTWMGAFGKQLVPFMLVMKLGGDEALVAAARDLARELRWDPWEKDPLTFYCITPEKMAVGRQFRTFRDRLQTLMARDLWRSFLAANPHLQDWALEEHGLESPEELTYEELKKLPSIKGQPRFLELYIVGHNINGFDEIVLAAQVINNRSSVPGPFRITRNFMPRAGKILFNDLTFSLPNPRSKKRTDYTLWEQGGCDDTDFKHQYLKVMVRDTFALTHTSLRKAAQAYALPVEKGCCPYQAVNQFYMLGSYRSDTDGFPLQEYWKDREEFVLNRELWKKKGEDKYDIIRETLDYCALDVQVTAELVHKLRESYASFVRDSVGLQEASFNVFQRPTISSNSHAIFRQIAFRAERPQRTNLGPNMLAPSHELYDYVRASIRGGRCYPTYLGILREPLYVYDICGMYASALTHPMPWGPPLNPYERALAAREWQRALDMQACKIDYFDPRLLPGVFTIDADPPNEDQLDPLPPFCSRKGGRLCWTNERLRGEVATSVDMVTLHNRGWRVRLIPDERTTVFPEWKCVAREYVQLNIAAKERADRDKNQTLRSIAKLLSNALYGSFATKLDNKKIVFSDQMDPGTLKGITSGQVNIKSSSFLETDNLSAEVMPAFEREYLPQQLALADSDAEESEDERAPTPFYTPPSGTPGHVSYTYKPITFLDAEEGDMCLHTLEKVDPLVDNDRYPSHVASFVLAWTRAFVSEWSEFLYEEDRGTPLEDRPLKSVYGDTDSLFVTEKGHRLMESRGKKRIKKHGGNLVFDPDRPELTWLVECETVCASCGADAYSPESVFLAPKLYALKSLQCPSCGATSKGKLRAKGHAAEGLDYETMVKCYLADAQGEERQRFSTSRTSLKRTLASAQPGAHPFTVTQTTLTRTLRPWKDMTLAPLDAHRLVPYSESRPNPRNEEICWIEMP

SEQ ID NO: 20 - protein, 621 aa, Gorilla beringei graueri
MRRAAMFEEGPPPSYESAMGFSPATPLQPPYVPPRYLQPTGGRNSICYSELQPLYDTTKVYLVDNKSADVASLNYQNDHSDFLTTVIQNNDFTPNEASTQTINLDNRSHWGGDLKTILHTNMPNVNEFMFTNSFKARVMVARDDKGVPKYEWVDFTLPEGNYSEIMTLDLMNNAIVEHYLKVGRQNGVKESDIGVKFDTRNFRLGWDPETGLVMPGVYTNEAFHPDIVLLPGCGVDFTQSRLSNLLGIRKRQPFQEGFQITYEHLEGGNIPALLDLVAYEESLKSEESGDNTDKGGEEQAGDGDTASVENESASVVEAAAVATAEPETVEEDMNDSAIRGDSFIPRGEEKKAEAAAAVEAEPKVESEIMEEDLNDNAIRGDTFVPRGEEKKAEAEAAAEEAAEAVAATAAVTETTEEQVQAEQVQKKPVIKALTQDSKERSYNLIPGSTDTEYRSWYLAYNYGDPVKGVRSWTLLCTPDVTCGSEQMYWSLPNMMQDPVTFRSTRQVNNFPVVGAELLPVHSKSFYNEQAVYSQLIRQATSLTHVFNRFPENQILARPPAPTITTVSENVPALTDHGTLPLRNSISGVQRVTITDARRRTCPYVYKALGIVSPRVLSSRTF

SEQ ID NO: 21 - protein, 947 aa, Gorilla beringei graueri
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWDEKTNTAEAAIENEEELADEPEEQAEEAIKTNVFAQAPYSGNAISKEGIQVGIEGIGEQVKAVYADKTYQPEPQVGETQWNETEINHGAGRVLKKTTPMKPCYGSYAKPTNEYGGQGILVEKNGKMESQVETQFFALDGENDNSPKVVLYSEDVNLDTPDTHLSYKPSAQDVNSKEMLGQQAMPNRPNLIAFRDNFIGLMYYNSTGNMGVLAGQASQLNAVVDLQDRNTELSYQLMLDSIGDRSRYFAMWNQAVDSYDPDVRIIENHGTEDELPNYCFPLGGIFNTQSFKKVKPGTDNGWETDDDFSDKNEIRVGNNFAMEINIQANLWRSFLYSNVALYLPDKMKYSPTNIDISTNTNTYDYMNKRVAPPGLVDCYVNLGARWSLDVMDNMNPFNHHRNAGLRYRSMLLGNGRYVPFHIQVPQKFFAIKSLLLLPGSYTYEWNFRKDVNMVLQSSLGNDLRVDGASIKFDSITLYATFFPMAHNTASTLEAMLRNDTNDQSFNDYLSGANMLYPIPANATNVPISIPSRNWAAFRGWAFTRLKTKETPSLGSGFDPYFVYSGSIPYLDGTFYLNHTFKKISIMYDSSVSWPGNDRLLTPNEFEVKRAVDGEGYNVAQCNMTKDWFLVQMLANYNIGYQGFYIPESYKDRMYSFFRNFQPMSRQVVDETKYKDYQAVGITHQHNNSGFVGYLAPTMREGQAYPANFPYPLIGKTAVDSVTQKKFLCDRTLWRIPFSSNFMSMGALTDLGQNLLYANSAHALDMTFEVDPMDEPTLLYIVFEVFDVVRVHQPHRGVIETVYLRTPFSAGNATT

SEQ ID NO: 22 - protein, 580 aa, Gorilla beringei graueri
MKRARSSDETFNPVYPYDTEIAPTSVPFPTPPFVSPAGMQENPPGVLSLRLAEPLTTSNGALTLKMGGGLTLDEEGKLTSQNITSVDPPLKKTKNNISLQTASPLAVSSGALTLFATPPLAVNDNNLTVQSQAPLTLENSKLSLATKGPLTVSEGKLALETEAPLHASDSSSLGLSVTAPLSISSDSLGLDLQAPIISENGKLGLRVTGPLTVASSIDALTVATGSGIGLDSNTRLQAKLVAPLGFDTNGNIKLSTSGGMRLNNGTLILDVNYPFEAQGQLSLRVGSGPLYVDSNTHNLTARCLRGLYITSSNNQTGLEANIKLTKGLVFDGNAIAVNVSKGLEYSTTETAQGVNPIQTKIGLGMEYDTNGAIKPRLGSGLSFDNSGAIVVGNKNDDTLTLWTTPDPSPNCQINSEKDAKLTLVLTKCGSQIVGTVSAFALKGSLAPINGTVSSVSIFLRFNENGVLMSNSSLESQYWNYRNGNSTNATPYTNALGFMPNLAAYPKGQATTAKSSIISQVYMNGDTSKPMIFTITFNGLETEETQVSTYSMTFSWRWTNGDYVGHYFKTNSFTFSYIAQE

SEQ ID NO: 23 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 24 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 25 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 26 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 27 - DNA, 37073 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 28 - DNA, 37074 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 29 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 30 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 31 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 32 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 33 - DNA, 37057 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 34 - DNA, 37058 bp, Gorilla beringei graueri
ataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagcgcgtaatatttaccgagggccgagggactttgaccgattacgtggaggactcgcccaggtgttttttacgtgaatttccgcgttccgggtcaaagtctccgtttttattgtcaccgtcatttgacgcggagggtatttaaacccgctgcgctcctcaagaggccactcttgagtgccagcgagaagagttttctcctctgctccgcttcggtgatcgaaaaatgagacacatagcctgcactccgggtcttttgtccggtcgggcggcggccgagcttttggacgctttgatcaatgatgtcctgagcgatgattttccgtctactacccactttagcccacctactcttcacgaactgtacgatctggatgtactggtggatgtgaacgatcccaacgaggaggcggtttctgcgttttttcccgagtctgcgctgttggccgctcaggagggatttgacctacacactccgccgcctattttagagtctccgctgccggagcccagtggtataccttatatgcctgaactgcttcccgaagtggtagacctgacctgccacgagcctggctttccgcccagcgacgatgatggtgagccttttgttttagactttgctgagatacctgggcacggttgcaggtcttgtgcatatcatcagagggttaccggagaccccgaggttaagtgttcgctgtgctatatgaggatgacctcttcctttatctacagtaagtttttgtctaggtgggcttttgggtaggtgggttttgtgtcagaacaggtgtaaacgttgcttgtgttttttgtacctgtaggtccggtgtccgagccagacccggagcccgaccgcgatcccgagccggatcccgagcctcctcgcaggacaaggaaactaccttccattctgtgcaagtctcagacacctgtaaggaccagcgaggcagacagcaccgactctggcacttctacctctccccctgaaattcacccagtggttcctctgggtatacataaacctgttgctgttagagtttgcgggcgacgccctgcagtacagtgcattgaggacttgcttcacgatcccgaggaacctttggacttgagccttaaacgccctaggcaataaaccccacctaagtaataaaccccacctaagtaataaaccctgccgcccttggttattgagatgacgcccaatgtttgcttttgaatgacttcatgtgtgtaataaaagtgagtgtgatcataggtctcttgtttgtctgggcggggcttaagggtatataagtttctcggggctaaacttggttacacttgaccccaatggaggcgtgggggtgcttggaggagtttgcggacgtgcgccgtttgctggacgagagctctaaccatacctatactatttggaggtatctgtggggctctactcaggccaagttggtctccagaattaagcaggattacaagtgcgattttgaagagctttttagttcctgcggtgagcttttgcaatccttgaatctgggccatcaggctattttccaggaaaaggttctctcgactttggatttttccactcccgggcgcaccgccgcttgtgtggcttttgtgtcttttgtgcaagataaatggagcgaggagacccacctgagtcacggctacgtactggatttcatggcgatggctctttggagggctcacaacaaatggaagattcagaaggaactgtacggttccgccctacgtcgtccacttttgtcgcgacaggggctgaggtttcccgaccatcggcagcatcagaatctggaagacgagtcggaggagcgagcggaggagaagatcagcttgagagccggcctggaccctcctcaggaggaatgaatctcccgcaggtggttgacctgtttccagaactgagacgggtcctgactatcagggaggatggtcagtttgtgaagaagtttaagagggatcggggtgagggagatgatgaggcggctagcaatttagcttttagtctgatgactcgccaccgaccggaatgtattacctatcagcagattaaggagagttgtgccaacgagctggatcttttgggtcagaagtatagcatagaacagcttaccacttactggcttcagcctggggatgattgggaagaggcgatcagggtgtatgcaaaggtggccctgcggcccgattgcaagtataagattactaagttggttaatattagaaactgctgctatatttctgggaacggggccgaagtggagatagatactcaggacagggtggcttttaggtgttgcatgataaacatgtggcccgggatactggggatggatggggtggtgttcatgaatgtgaggtttacgggccccaactttaatggcacggtgttcatgggcaacaccaacttgctcctgcatggtgcgagtttctatgggtttaataacacctgtatagaggcctggaccgatgtaaaggttcgaggttgttccttttatagctgttggaaggcggtggtgtgtcgccctaaaagcaggggttctgtgaaaaaatgcttgtttgaaaggtgcaccttaggcatcctctctgagggcaactccagggtgcgccataatgtggcttcgaactgcggttgcttcatgcaagtgaagggggtgagcgttatcaagcataactcggtgtgtggaaactgcgaggatcgcgcctcccagatgctgacctgctttgatggtaactgtcacctgttgaagaccattcatataagcagccaccccagaaaggcctggcccgtgtttgagcataacatcctgacccgctgctccttgcatctgggggtcaggaggggtatgttcctgccttaccagtgtaactttagccacactaaaatcctgctggaacccgagtgtatgaccaaggtcagcctaaatggcgtgtttgatgcgactctgagaatctggaaggtgctgaggtatgatgagaccaggaccaggtgccgaccctgcgagtgcggcggcaagcacatgagaaatcagcctgtgatgttggatgtgaccgaggagcttaggcctgaccatctggtgctggcctgcaccagggccgagtttgggtctagcgatgaggataccgattgaggtgggtaaggtgggcgtggctagaagggtggggcgtgtataaattgggggtctaagggtctctctgttttgtcttgcaacagccgccgccatgagcgacaccggcaacagctttgatggaagcatctttagcccctatctgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcggcgcggcctctcgcgcgtctgctcgggatgagaaactgaccgctctgctgcttaaactggaagacttgacccgggagctggctcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaaatcaacatacctttttatccagatatcagagaactctagtggtcagttttcccccaccctcccagctcacagaatacacagtcctttccccccggctggctttaaacaacactatctcattggtaacagacatattcttaggtgtaataatccacacggtctcttggcgggccaaacgctggtcggtgatgttaataaactccccaggcagctctttcaagttcacgtcgctgtccaactgctgaagcgctcgcggctccgactgcgcctctagcggaggcaacggcaacacccgatccttgatctataaaggagtagagtcataatcccccataagaatagggcggtgatgcagcaacaaggcgcgcagcaactcctgccgccgcctctccgtacggcaggaatgcaacggcgtggtggtctcctccgcgataatccgcaccgctcgcagcatcagcatcctcgtcctccgggcacagcagcgcatcctgatctcactgagatcggcgcagtaagtgcagcacaaaaccaagatgttatttaagatcccacagtgcaaagcgctgtacccaaagctcatggcgggaaggacagcccccacgtgaccatcataccagatcctcaggtaaatcaaatgacgacctctcataaacacgctggacatgtacatcacctccttgggcatgtgctgattcaccacctctcgataccacaagcatcgctgattaattaaagacccctcgagcaccatcctgaaccaggaagccagcacctgaccccccgccaggcactgcagggaccccggtgaatcgcagtggcagtgaagactccagcgctcgtagccgtgaaccatagagctggtcattatatccaaattggcacaacacagacacactttcatacactttttcatgattagcagctcctctctagtcaggaccatatcccaaggaatcacccactcttgaatcaaggtaaatcccacacagcagggcaggcctctcacataactcacgttatgcatagtgagcgtgtcgcaatctggaaataccggatgatcttccatcaccgaagcccgggtctccgtctcaaagggaggtaaacggtccctcgtgtagggacagtggcgggataatcgagatcgtgttgaacgtagagtcatgccaaagggaacagcggacgtactcatatttcctccagcagaaccaagtgcgcgcgtggcagctatccctgcgtcttctgtctcgccgcctgccccgttcggtgtagtagttgtaatacagccactccctgagaccgtcaaggcgctccctggcgtccggatctatgacaacaccgtcctgcagcgccgccctgatgacatccaccaccgtagagtatgccaagcccagccaggaaatgcattcactttgacagcgagagataggaggagcggggagagatggaagaaccatgatagtaaagagaacttttattccaatcgatcttctaagatatcaaagtggagatctataagatgacactggtctcctccgctgagtcgatcaaaaataacagctaaaccacaaacaacacgattggtcaaatgctccacaagggcctgcagcataaaattgcctcggaactccaccgcaagcataacatcaaagccaccgcctctatcgtgatcaagaataaaaaccccacagctatccaccagacccatatagttttcatctctccatcgtgaaaaaagatttacaagctcctcctttaaatcacctccaaccaattgaaaaagttgaaccagaccgccctccaccttcattttcagcaagcgtatcatgattgcaaaaattcaggctcctcagacacctgtataagattgagaagcggaacgttaacatcgatgtttcgctcgcgtaaatcacgcctcagtgcaagcataatataatcccacaggtcggagcggatcagcgaggacacctccccgccaggaaccaactcaacggagcctatgctgattataatacgcatattcggagctatgctaaccagcacggcccccaaataggcgtactgcataggcggcgacaaaaagtgaacagtttgggttaaaaaatcaggcaaacactcgcgcaaaaaagcaagaacatcataaccatgctcatgcaaatagatgcaagtaagctcaggaacgaccacagaaaaatgcacaatttttctctcaaacatgactgcgagccctgcaaaaaataaaaaagaaacattacacaagagtagcctgtcttacgatgggatagactactctaaccaacataagacgggccacaacatcgcccgcgtggccataaaaaaaattgtccgtgtgattaaaaagaagcacagatagctggccagtcatatccggagtcatcacgtgtgaacccgtgtagacccccgggttggacacatcggccaaagaaagaaagcggccaatgtacccaggaggaattataacactaagacgaagatacaacagaataaccccatgagggggaataacaaagttagtaggtgaataaaaacgataaacacccgaaactccctcctgcgtaggcaaaatagcaccctccccttccaaaacaacatatagcgcttccacagcagccatgacaaaagactcaaaacactcaaaagactcagtcttaccaggaaaataaaagcactctcacagcaccagcactaatcagagtgtgaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattat

SEQ ID NO: 35 - DNA, 33861 bp, Gorilla beringei graueri
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcttaggcctgaccatctggtgctggcctgtaccagggccgagtttgggtctagcgatgaggataccgattgaggtgggtaaggtgggcgtggctagcagggtggggcgtgtataaattgggggtctaagggtctctctgttttgtcttgcaacagccgccgccatgagcgacaccggcaacagctttgatggaagcatctttagcccctatttgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcagcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

SEQ ID NO: 36 - DNA, 33861 bp, Gorilla beringei graueri
  misc_feature (489)..(489): C,T
  misc_feature (671)..(671): C,T
  misc_feature (887)..(887): A,G
catcatcaataatataccttattttggattgtggccaatatgataatgaggtgggcggggagaggcggggcgggtgacgtaggacgcgcgagtagggttgggaggtgtggcggaagtgtggcatttgcaagtgggaggagctcacatgcaagcttccgtcgcggaaaatgtgacgtttttgatgagcgccgcctacctccggaagtgccaattttcgcgcgcttttcaccggatatcgtagtaattttgggcgggaccatgtaagatttggccattttcgcgcgaaaagtgaaacggggaagtgaaaactgaataatagggcgttagtcatagtgcgtaatatttaccgagggccgagggactttgaccgattacgtggaggactcgcccaggtgttttttacgtgaatttccgcgttccgggtcaaagtctccgttttattgtcaccgtcatttgacgcttaggcctgaccatctggtgctggcctgyaccagggccgagtttgggtctagcgatgaggataccgattgaggtgggtaaggtgggcgtggctagmagggtggggcgtgtataaattgggggtctaagggtctctctgttttgtcttgcaacagccgccgccatgagcgacaccggcaacagctttgatggaagcatctttagcccctatytgacagtgcgcatgcctcactgggctggagtgcgtcagaatgtgatgggttccaacgtggatggacgccccgttctgccttcaaattcgtctacaatggcctacgcgaccgtgggaggaactccgctggacgccgcgacctccgccgccgcctccgccgccgccgcgaccgcgcgcagcatggctacggacctttacagctctttggtggcgagcrgcgcggcctctcgcgcgtctgctcgggatgagaaactgaccgctctgctgcttaaactggaagacttgacccgggagctgggtcaactgacccagcaggtctccagcttgcgtgagagcagccttgcctccccctaatggcccataatataaataaaagccagtctgtttggattaagcaagtgtatgttctttatttaactctccgcgcgcggtaagcccgggaccagcggtctcggtcgtttagggtgcggtggattctttccaacacgtggtacaggtggctctggatgtttagatacatgggcatgagtccatccctggggtggaggtagcaccactgcagagcttcgtgctcgggggtggtgttgtatatgatccagtcgtagcaggagcgctgggcgtggtgctgaaaaatgtccttaagcaagaggcttatagctagggggaggcccttggtgtaagtgtttacaaatctgctcagttgggaggggtgcatccggggggatataatgtgcatcttggactggatttttaggttggctatgttcccacccagatcccttctgggattcatgttgtgcaggaccaccagcacggtatatccagtgcacttgggaaatttatcgtggagcttagacgggaatgcatggaagaacttggagacgcccttgtggcctcccagattttccatacattcgtccatgatgatggcaatgggcccgtgggaagctgcctgagcaaaaatgtttctgggatcgctcacatcgtagttatgttccagggtgaggtcatcataagacatctttacaaatcgggggcggagggtcccggactggggtatgatggtaccctcgggccccggggcgtagttcccctcacagatctgcatctcccaggctttcatttcagagggagggatcatatccacctgcggagcgatgaaaaacacagtttctggcgcaggggagattaactgggatgagagcaggtttctgagcagctgtgactttccacagccggtgggcccatatatcacgcctatcaccggctgcagctggtagttaagagagctgcagctgccgtcctcccggagcaggggggccacctcgttcagcatatccctgacgtggatgttctccctgaccaattccgccagaaggcgctcgccgcccagcgaaagcagctcttgcaaggaagcaaaatttttcagcggttttaggccgtcggccgtgggcatgtttttcagcgtctgggtcagcagttccagcctgtcccacagctcggtgatgtgctctacggcatctcgatccagcagatctcctcgtttcgcgggttggggcggctttcgctgtagggcaccagccgatgggcgtccagcggggccagagtcatgtccttccatgggcgcagggtcctcgtcagggtggtctgggtcacggtgaaggggtgcgctccgggttgggcgctggccagggtgcgcttgaggctggttctgctggtgctgaatcgctgccgctcttcgccctgcgcgtcggccaggtagcatttgaccatggtctcgtagtcgagaccctcggcggcgtgccccttggcgcggagctttcccttggaggtggcgccgcacgaggggcactgcaggctcttcagggcgtagagcttgggagcgagaaacacggactctggggagtaggcgtccgcgccgcaggaagcgcagaccgtctcgcattccaccagccaagtgagctccgggcggtcagggtcaaaaaccaggttgcccccatgctttttgatgcgtttcttacctcggctctccatgaggcggtgtcccttctcggtgacgaagaggctgtccgtgtccccgtagaccgacttcaggggcctgtcttccagcggagtgcctctgtcctcctcgtagagaaactctgaccactctgagacgaaggcccgcgtccaggccaggacgaaggaggccacgtgggaggggtagcggtcgttgtccactagcgggtccaccttctccagggtgtgcaggcacatgtccccctcctccgcgtccagaaaagtgattggcttgtaggtgtaggacacgtgaccgggggttcccgacgggggggtataaaagggggtgggcgccctttcatcttcactctcttccgcatcgctgtctgcgagagccagctgctggggtaagtattccctctcgaaggcgggcatgacctcagcgctcaggttgtcagtttctaaaaatgaggaggatttgatgttcacctgtcctgaggtgatacctttgagggtacctgggtccatctggtcagaaaacactatttttttgttgtcaagcttggtggcgaacgacccgtagagggcgttggagagcagcttggcgatggagcgcagggtctggtttttgtcgcggtcggctcgctccttggccgcgatgttgagttgcacgtactcgcgggccacgcacttccactcggggaagacggtggtgcgctcgtctgggatcaggcgcaccctccagcctcggttgtgcagggtgaccatgtcgacgctggtggcgacctcgccgcgcaggcgctcgttggtccagcagaggcggccgcccttgcgcgagcagaaggggggtagggggtccagctggtcctcgtttggggggtccgcgtcgatggtgaagaccccggggagcaagcgcgggtcaaagtagtcgatcttgcaagcttgcatgtccagagcccgctgccattcgcgggcggcgagcgcgcgctcgtaggggttgaggggcgggccccagggcatggggtgggtgagcgcggaggcgtacatgccgcagatgtcatacacgtacaggggttccctgaggatgccgaggtaggtggggtagcagcgccccccgcggatgctggcgcgcacgtagtcatagagctcgtgggagggggccagcatgttgggcccgaggttggtgcgctgggggcgctcggcgcggaaggcgatctgcctgaagatggcatgggagttggaggagatggtgggccgctggaagacgttgaagcttgcttcttgcaagcccaccgagtccctgacgaaggaggcgtaggactcgcgcagcttgtgcaccagctcggcggtgacctggacgtcgagcgcgcagtagtcgagggtctcgcggatgatgtcatacttatcctcccccttctttttccacagctcgcggttgaggacgaactcttcgcggtctttccagtactcttggaggggaaacccgtccgtgtccgaacggtaagagcctagcatgtagaactggttgacggcctggtaggggcaacagcccttctccacgggcagcgcgtaggcctgcgccgccttgcggagggaggtgtgggtgagggcgaaagtgtccctgaccatgactttgaggtattgatgtttgaagtctgtgtcatcgcagccgccctgttcccacagggtgtagtccgtgcgctttttggagcgcgggttgggcagggagaaggtgaggtcattgaagaggatcttccccgctcgaggcatgaagtttctggtgatgcgaaagggccctgggaccgaggagcggttgttgatgacctgggcggccaggacgatctcgtcaaagccgtttatgttgtggcccacgatgtagagctccaaaaagcggggctggcccttgatggaggggagctttttgagttcctcgtaggtgagctcctcgggcgattccaggccgtgctcctccagggcccagtcttgcaagtgagggttggccgccaggaaggatcgccagaggtcgcgggccatgagggtctgcaggcggtcgcggaaggttctgaactgtcgccccacggccatcttttcgggggtgatgcagtagaaggtgagggggtctttctcccaggggtcccatctgagctctcgggcgaggtcgcgcgcggcggcgaccagagcctcgtcgccccccagtttcatgaccagcatgaagggcacgagctgcttgccaaaggctcccatccaagtgtaggtctctacatcgtaggtgacaaagaggcgctccgtgcgaggatgagagccgatcgggaagaactggatctcccgccaccagttggaggattggctgttgatgtggtgaaagtagaagtcccgtctgcgggccgagcactcgtgctggcttttgtaaaagcgaccgcagtactggcagcgctgcacgggttgtatatcttgcacgaggtgaacctggcgacctctgacgaggaagcgcagcgggaatctaagtcccccgcctggggtcccgtgtggctggtggtcttctactttggttgtctggccgccagcatctgtctcctggagggcgatggtggagcagaccaccacgccgcgagagccgcaggtccagatctcggcgctcggcgggcggagtttgatgacgacatcgcgcacattggagctgtccatggtctccagctcccgcggcggcaggtcagctgggagttcctggaggttcacctcgcagagacgggtcaaggcgcgggcagtgttgagatggtatctgatttcaaggggcgtgttggcggcggagtcgatggcttgcaggaggccgcagccccggggggccacgatggttccccgcggggcgcgaggggaggcggaagctgggggtgtgttcagaagcggtgacgcgggcgggcccccggaggtagggggggttccggccccacgggcatgggcggcaggggcacgtcttcgccgcgcgcgggcaggggctggtgctggctccgaagagcgcttgcgtgcgcgacgacgcgacggttggtgtcctgtatctggcgcctctgagtgaagaccacgggtcccgtgaccttgaacctgaaagagagttcgacagaatcaatctcggcatcgttgacagcggcctggcgcaggatctcctgcacgtcgcccgagttgtcctggtaggcgatctctgccatgaactgctcgatctcttcctcctggagatctcctcgtccggcgcgctccacggtggccgccaggtcgttggagatgcgacccatgagctgcgagaaggcgttgagcccgccctcgttccagacccggctgtagaccacgcccccctcggcgtcgcgggcgcgcatgaccacctgggccaggttgagctccacgtgtcgcgtgaagacggcgtagttgcgcaggcgctggaaaaggtagttcagggtggtggcggtgtgctcggcgacgaagaagtacatgacccagcgccgcaacgtggattcattgatgtcccccaaggcctccaggcgctccatggcctcgtagaagtccacggcgaagttgaaaaactgggagttgcgagcggacacggtcaactcctcctccagaagacggatgagctcggcgacagtgtcgcgcacctcgcgctcgaaggccacggggggcgcttcttcctcttccacctcttcttccatgatcgcttcttcttcttcctcagccgggacgggagggggcggcggcggcgggggaggggcgcggcggcggcggcggcgcaccgggaggcggtcgatgaagcgctcgatcatctccccccgcatgcggcgcatggtctcggtgacggcgcggccgttctcccgggggcgcagctcgaagacgccgcctctcatctcgccgcggggcgggcggccgtgaggtagcgagacggcgctgactatgcatcttaacaattgctgtgtaggtacgccgccgagggacctgattgagtccagatccaccggatccgaaaacctttggaggaaagcgtctatccagtcgcagtcgcaaggtaggctgagcaccgtggcgggcgggggcgggtctggagagttcctggcggagatgctgctgatgatgtaattaaagtaggcggtcttgagaaggcggatggtggacaggagcaccatgtctttgggtccggcctgttggatgcggaggcggtcggccatgccccaggcctcgttctgacaccggcgcaggtctttgtagtagtcttgcatgagtctttccaccggcacctcttctccttcctcttctccatctcgccggtggtttctcgcgccgcccatgcgcgtgaccccaaagcccctgagcggctgcagcagggccaggtcggcgaccacgcgctcggccaagatggcctgctgcacctgagtgagggtcctctcgaagtcatccatgtccacgaagcggtggtaggcgcccgtgttgatggtgtaggtgcagttggccatgacggaccagttgacggtctggtgtcccggctgcgagagctccgtgtaccgcaggcgcgagaaggcgcgggaatcgaacacgtagtcgttgcaagtccgcaccagatactggtagcccaccaggaagtgcggcggaggttggcgatagaggggccagcgctgggtggcgggggcgccgggcgccaggtcttccagcataaggcggtggtatccgtagatgtacctggacatccaggtgatgccggcggcggtggtggtggcgcgcgcgtagtcgcggacccggttccagatgtttcgcaggggcaagaagtgttccatggtcggcacgctctggccggtgaggcgcgcgcagtcgttgacgctctatacacacacaaaaacgaaagcgtttacagggctttcgttctgtagcctggaggaaagtaaatgggttgggttgcggtgtgccccggttcgagaccaagctgagctcggccggctgaagccgcagctaacgtggtattggcagtcccgtctcgacccaggccctgtatcctccaggatacggtcgagagcccttttgctttcttggccaagcgcccgtggcgcgatctgggatagatggtcgcgatgagaggacaaaagcggctcgcttccgtagtctggagaaacaatcgccagggttgcgttgcggcgtaccccggttcgagcccctatggcggcttggatcggccggaaccgcggctaacgagggccgtggcagccccgtcctcaggaccccgccagccgacttctccagttacgggagcgagccccttttgtttttttattttttagatgcatcccgtgctgcggcagatgcgcccctcgccccggcccgatcagcagcagcaacagcaggcatgcagacccccctctcccctttccgccccggtcaccacggccgcggcggccgtgtcgggcgcggggggcgcgctggagtcagatgagccaccgcggcggcgacctaggcagtatctggacttggaagagggcgagggactggcgcggctgggggcgaactctccagagcgccacccgcgggtgcagttgaaaagggacgcgcgcgaggcgtacctgccgcggcagaacctgtttcgcgaccgcgggggcgaggagcccgaggagatgcgagactgcaggttccaagcggggcgcgagctgcggcgcgggctggacagacagcgcctgctgcgcgaggaggactttgagcccgacacgcagacgggcatcagccccgcgcgcgcgcacgtagccgcggccgacctggtgaccgcctacgagcagacggtgaaccaggagcgcaacttccaaaagagcttcaacaaccacgtgcgcacgctggtggcgcgcgaggaggtgaccctgggtctcatgcatctgtgggacctggtggaggcgatcgtgcagaaccccagcagcaagcccctgaccgcgcagctgttcctggtggtgcagcacagcagggacaacgaggccttcagggaggcgctgctgaacatcaccgagccggaggggcgctggctcctggacctgataaacatcctgcagagcatagtggtgcaggagcgcagcctgagcctggccgagaaggtggcggccatcaactactctatgctgagcctgggcaagttctacgcccgcaagatctacaagaccccctacgtgcccatagacaaggaggtgaagatagacagcttctacatgcgcatggcgctgaaggtgctgaccctgagcgacgacctgggagtgtaccgcaacgagcgcatccacaaggccgtgagcgccagccggcggcgcgagctgagcgaccgcgagctgatgcacagtctgcagcgcgcgctgaccggcgcgggcgagggcgacagggaggtcgagtcctacttcgacatgggggccgacctgcactggcagccgagccgccgcgccctggaggcggcgggggcgtacggcggccccctggcggacgatgaccaggaagaggaggactatgagctagaggagggcgagtacctggaggactgacctggctggtggtgttttggtatagatgcaagatccgaacgtggcggacccggcggtccgggcggcgctgcagagccagccgtccggcattaactcctctgacgactgggccgcggccatgagtcgcatcatggccctgaccgcgcgcaaccccgaggctttcaggcagcagcctcaggccaaccggctggcggccatcttggaagcggtagtgcccgcgcgctccaaccccacccacgagaaggtgctggccatagtcaacgcgctggcggagagcagggccatccgcgcggacgaggccggactggtgtacgatgcgctgctgcagcgggtggcgcggtacaacagcggcaacgtgcagaccaacctggaccgcctggtgacggatgtgcgcgaggccgtggcgcagcgcgagcgcttgcatcaggacggtaacctgggctcgctggtggcgctaaacgccttcctcagcacccagccggccaacgtaccgcgggggcaggaggactacaccaactttttgagcgcgctgcggctgatggtgaccgaggtccctcagagcgaggtgtaccagtcggggcccgactacttcttccagaccagcagacagggcttgcaaaccgtgaacctgagccaggctttgaagaacctgcgggggctgtggggagtgaaggcgcccaccggcgaccgggctacggtgtccagcctgctaacccccaactcgcgcctgctgctgctgctgatcgcgcccttcacggacagcgggagcgtctcgcgggaaacctatctgggccacctgctgacgctgtaccgcgaggccatcgggcaggcgcaggtggacgagcacaccttccaagagatcaccagcgtgagccacgcgctggggcaggaggacacgggcagcctgcaggcgaccctgaactacctgctgaccaacaggcggcagaagattcccacgctgcacagcctgacgcaggaggaggagcgcatcttgcgctacgtgcagcagagcgtgagcctgaacctgatgcgcgacggcgtgacgcccagcgtggcgctggacatgaccgcgcgcaacatggaaccgggcatgtacgcctcccaccggccgttcattaaccgcctgatggactacttgcatcgggcggcggccgtgaaccccgagtacttcactaatgccattctgaatccccactggatgccccctccgggtttctacaacggggacttcgaggtgcccgaggttaacgacgggttcctctgggatgacatggatgacagtgtgttctcacccaacccgctgcgcgccgcgtctctgcgattgaaggagggttctgacagggaaggaccgaggagtctggcctcctccctggctctgggagcggtgggcgcggcggcgcggggcagtagccccttccccagcctggcagactctctgaacagcgggcgggtgagcaggccccgcttgctaggcgaggaggagtatctgaacaactccctgctgcagcccgcgagggacaaaaacgctcagcggcagcagtttcccaacaatgggatagagagcctggtggacaagatgtccagatggaagacgtatgcgcaggagtacaaggagtgggaggaccgccagccgcggcccctgccgccccctaggcagcgctggcagcggcgcgcgtccaaccgccgctggaggcaggggcccgaggacgatgatgactctgcagatgacagcagcgtgctggacctgggcgggagcgggaaccccttttcgcacctgcgcccccgcctgggcaagatgttttaaaagagaaaaaataaaaactcaccaaggccatggcgacgagcgttggttttttgttcccttccttagtatgcgacgcgcggcgatgttcgaggaggggcctcccccctcttacgagagcgcgatgggattttctcctgcgacgcccctacagcctccctacgtgcctcctcggtacctgcaacctaccgggggaagaaatagcatctgttactctgagctgcagcccctgtatgacaccaccaaagtgtacctggtggacaacaagtctgcggacgtggcctccctgaactaccagaacgaccacagcgattttttgaccaccgtgatccaaaacaatgacttcaccccaaacgaggccagcacccagaccataaacctggacaacaggtcgcactggggcggtgatctgaagaccatcttgcacaccaacatgcccaacgtgaatgagtttatgtttactaactcttttaaggcgcgggtaatggtggcgcgcgacgataagggagtgcctaaatacgagtgggtggactttacactgcccgagggcaactactccgagatcatgactcttgacctgatgaacaacgcgatcgtggagcactacttgaaagtaggcaggcagaacggggtaaaagaaagcgatattggagttaagtttgacaccaggaactttcgcctgggatgggaccccgagacggggttggttatgcccggggtttacactaatgaagcttttcaccccgatatagtgctcttgcccggatgcggggtggacttcacccaaagccggctgagcaacctgctgggcattcgaaagcgccagccattccaggaggggtttcaaatcacttatgagcatttggaagggggcaacattccggcgcttctggatttggtcgcctacgaggagagtttgaaatccgaggaaagcggggataacactgacaagggcggcgaggagcaagccggcgatggcgacactgcttcggtagaaaacgaaagtgcgtccgtggtggaggcggcggcggtagcgaccgcagagccggagaccgtagaggaggatatgaatgatagcgcaatcagaggagactcgtttattccccggggcgaagaaaagaaggcggaggctgcggcagcagtcgaagcagagcccaaagtcgagtcggagatcatggaggaggatttgaatgataacgcgatcagaggtgatacgtttgtgccgcggggcgaagaaaaaaaagcggaggcggaggccgcggctgaggaggcggccgaggctgtggcagccaccgcggcggtgactgaaacaactgaggagcaggttcaggccgagcaggttcaaaagaagcccgtgattaaagccctaacacaagatagcaaggagcgcagttacaacttgattcccggtagtactgacaccgagtaccgcagctggtacctggcatacaactacggcgacccggtcaaaggggtgcgctcgtggactctgctttgcacgccggacgtcacctgcggctccgagcagatgtactggtcgttgccaaacatgatgcaagacccggtgaccttccgctccacgcggcaggttaacaacttcccggtggtgggcgccgaactgctgcccgtgcactccaagagcttttacaacgagcaggccgtgtactcccagctgatccgccaggccacctctctgacccacgtgttcaatcgctttcccgagaaccagattttggcgcgcccgccggcccccaccatcactaccgtcagtgaaaacgttcctgctctcacagatcacgggacgctaccgctgcgcaacagcatctcaggagtccagcgagtgaccattactgacgccagacgccggacctgcccctacgtttacaaggccttgggcatagtctcgccgcgcgtcctctccagccgcactttttaaaacacatattcacccacgcttcaaagattatgtctatacttatctcacccagcaataacaccggctgggggctgcgcgcgcccagcaagatgtttggaggggcgagaaaacgttccgagcagcacccagtgcgcgtgcgcggccactaccgcgcgccctggggagcgcacaagcgcgggcgcgcagggcgcaccactgtggacgacgccattgactccgtagtggagcaggcgcgccactacacacccggcgcgccgtccgcccccgccgtgtccaccgtggacgaggcgatcgaaagcgtggtacagggcgcgcggcactatgccaaccttaaaaatcgccgccgtcgcgtggcccgccgccatcgccggagaccccgggccaccgccgccgcgcgccttgctaaggctctactcaggcgcgccaggcgaactggccgccgggccgccatgagggccgcacggcgggctgccgccagtgcggccgccgcggccccacgggcacgaaggcgcgcggccgctgccgccgccgccgccatttccagcttggcctcaacgcggcgcggtaacatatactgggtgcgcgactcgataaccggcacgcgggtacccgtgcgctttcgccccccgcggaattagcacaagacaacatacacactgagtctcctgctgttgtgtatcccagcggcgaccgtcagcagcggcgacatgtccaagcgcaaaattaaagaagagatgctccaggtcatcgcgccggagatctatgggcccccgaagaaggaggaggatgattacaagccccgcaagctaaagcgggtcaaaaagaaaaagaaagatgatgatgatgacgaggcggtggagtttgtccgccgcatggcacccaggcgccccgtgcagtggaagggtcggcgcgtgcagcgcgttttgcgccccggcaccgcggtggtcttcacgcccggcgagcgctccacgcgcactttcaagcgggtgtacgatgaggtgtacggcgacgaggacctgttggagcaggccaaccagcgctttggggagtttgcatatgggaaacggccccgcgagagtctaaaagaggacctgctggcgctaccgctggacgagggcaatcccaccccgagtctgaagccggtgaccctgcaacaggtgctgcctttgagcgcgcccagcgagcataagcgagggttgaagcgcgagggcggggacctggcgcccaccgtgcagttgatggtgcccaagcggcagaagctggaggacgtgctggagaaaatgaaagtagagcccgggatccagcccgagatcaaggtccgccccatcaagcaggtggcgcccggcgtgggagtccagaccgtggacgttaggattcccacggaggagatggaaacccaaaccgccactccctcttcagcggccagcgccaccaccggcaccgcttcggtagaggtgcagacggacccctggctacccgccgccgctgtcgccgccgccgccgccccccgttctcgcgggcgcaagagaaattatccagtggccagcgcgctcatgccccagtacgcactgcatccatccatcgcgcccacccccggctaccgcgggtattcgtaccgcccgcgcagatcggccggcactcgcggccgccgccgccgtgcgaccacaaccagccgccgccgtcgccgccgccgccagccagtgctgacccccgtgtctgtaaggaaggtggctcgctcggggagcacgctggtggtgcccagagcgcgctaccaccccagcatcgtttaaagccggtctctgtatggttcttgcagatatggccctcacttgtcgcctccgcttcccggtgccgggataccgaggaagaactcaccgccgcagaggcatggcgggcagcggtctccgcggcggccgtcgccatcgccggcgcgcaaaaagcaggcgcatgcgcggcggtgtgctgcctctgctaatcccgctaatcgccgcggcgatcggtgccgtacccgggatcgcctccgtggccctgcaggcgtcccagaaacgttgactcttgcaaccttgcaagcttgcatttttttggaggaaaaataaaaaagtctagactctcacgctcgcttggtcctgtgactattttgtagaaaaaagatggaagacatcaactttgcgtcgctggccccgcgtcatggctcgcgcccgttcatgggagactggacagatatcggcaccagcagtatgagcggtggcgccttcagctggggcagtctgtggagcggccttaaaaattttggttccaccattaaaaactatggcaacaaagcgtggaacagcagcacgggccagatgctaagagacaagttgaaagagcagaacttccaggagaaggtggcgcagggcctggcctctggcatcagcggggtggtggacatagctaaccaggccgtgcagaaaaagataaacagtcatctggacccccgccctcaggtggaggaaacgcctccagccatggagacggtgtttcccgagggcaaaggcgaaaagcgcccgcggcccgacagggaagagaccctggtgtcacacaccgaggagccgccctcttacgaggaggcactcaaggccggcctgcccaccactcgccccgtagctcccatggccacaggtgtggtgggccataaacaacacacccccgcaacactagatctgcccccgccgtccgagccgccgcgtcagccaaagacggcgacggtgcccgctccctccacttccgccgccaacagagtgtccctgcgccgcactacgggcgcccctcggggaccgcgactgagcggcaactggcagagcacactgaacagcattgtgggcctgggagtgaaaagtgtgaagcgccgccgttgctactgaatgagcaagctagctaacgtgttatatgtgtgtatgcgtcctatgtcgccgccagaggagctgttgagccgcccgcgccgtctgcactccagcgaatttcaagatggcgaccccttcgatgatgccacagtggtcgtacatgcacatctcgggccaggacgcctcggagtacctgagccccgggctggtgcagttcgcccgcgccaccgacagctacttcagcctaagtaacaaatttaggaaccctacggtggcacccacccacgatgtgaccacggaccggtcgcagcgcctgacgctgcggtttatccccgtggatcgggaggacactgcctactcttacaaggcgcgcttcacgctagccgtgggcgacaaccgcgtgctggacatggcctccacctactttgatatccggggtgtgctggacaggggtcccacctttaagccctactcgggcactgcctacaactccctggctcctaaaggcgctcccaattcttgcgagtgggatgaaaaaactaatactgctgaagcagccattgaaaatgaagaagagctggcggatgagccagaagagcaagcagaagaggctataaaaaccaatgtgtttgcccaggcgccatattctggcaatgcaatttccaaagaaggaatacaagtaggcatagaaggcattggagagcaagtaaaagccgtatacgcagacaaaacctaccagccggaacctcaggttggagaaactcaatggaatgagactgaaataaatcatggagcaggaagggtgctgaagaagaccactcccatgaagccttgctatggttcttatgctaaacctactaatgaatatggaggccagggcatccttgtagaaaaaaatggcaaaatggaaagccaggtggaaacacagttttttgctcttgacggtgaaaatgataatagtccaaaagtggtgttgtatagcgaagatgtaaacttggatactcctgacacacacctatcatacaaacctagcgcccaagatgtaaactctaaagaaatgttgggccaacaggccatgcccaacaggccaaatcttattgcttttagggacaactttattggacttatgtactacaacagcactggcaacatgggagtgctggcaggacaggcctcccaactaaatgccgtggtagacttgcaagacagaaacacagagttgtcataccagctgatgcttgattccattggagacagatcaagatattttgccatgtggaaccaggcggttgatagttacgatccagatgttagaattattgaaaaccatggcacagaggatgaacttccaaactactgttttcctttgggaggaatatttaatactcagagttttaaaaaggtaaaacctggaacggataacggatgggaaacagatgatgacttttcagataaaaatgaaataagagttggcaacaactttgccatggagatcaatatccaggcaaacctgtggagaagcttcttgtattccaatgtggctctctacctgccagataagatgaagtactctccaaccaacatagacatttccaccaacactaacacctatgactacatgaacaaaagagtggcgcctccaggcctggtggactgctatgtcaatctgggggccaggtggtcccttgatgtaatggataacatgaacccctttaaccaccaccgcaatgcgggcctgcgataccgttccatgcttctgggtaacggccgctacgtgcccttccacatccaggtgccccaaaagttctttgccatcaaaagccttctactcttgcctggctcgtacacctacgaatggaatttcagaaaggatgtgaacatggtcctacagagctctctgggcaacgaccttagggtggatggggccagcatcaagtttgacagcatcaccctttatgctacctttttccccatggcccacaacaccgcttccacgcttgaggccatgctcagaaacgacaccaacgaccagtccttcaatgactacctctctggggccaacatgctctaccccatccccgccaacgctaccaacgtgcccatctccattccctctcgcaactgggccgccttcagaggctgggcatttacccgccttaagaccaaggagaccccctccctgggctcgggttttgacccctactttgtctactcgggatccatcccctacctggatggcaccttctacctcaaccacacttttaagaagatatccatcatgtatgactcctctgtcagctggccgggcaacgaccgcctgctcacccccaatgagttcgaggtcaagcgcgccgtggacggcgagggctacaacgtggcccagtgcaacatgaccaaggactggttcctggtgcagatgctggccaactacaacataggctaccagggcttctacatcccagagagctacaaggacaggatgtactccttcttcagaaatttccaacccatgagcaggcaggtggtggacgagaccaaatacaaggactatcaggccgttggcatcactcaccagcacaacaactcgggattcgtgggctacctggcacccaccatgcgcgagggacaggcctaccccgccaacttcccctaccccttgataggcaagaccgcggtcgacagcgtcacccagaaaaagttcctctgcgaccgcaccctctggcgcatccccttttctagcaacttcatgtccatgggcgcgctcacggacctgggccagaacctgctctatgccaactccgcccatgcgctggacatgacttttgaggtggaccccatggacgagcccacccttctctatattgtgtttgaagtgttcgacgtggtcagagtgcaccagccgcaccgcggtgtcatcgagaccgtgtacctgcgcacgcccttctcggccggcaacgccaccacctaaggagacagcgccgccgcctgcatgacgggttccaccgagcaagagctcagggccatcgccagagacctgggatgcggaccctattttttgggcacctatgacaaacgcttcccgggcttcatctcccgagacaagctcgcctgcgccatcgtcaacacggccgcgcgcgagaccgggggcgtgcactggctggcctttggctgggacccgcgctccaaaacttgctacctctttgacccttttggcttctccgatcagcgcctcaagcagatctatgagtttgagtacgaggggctgctgcgccgcagcgcgcttgcctcctcgcccgaccgctgcatcacccttgagaagtccaccgagaccgtgcaggggccccactcggccgcctgcggtctcttctgctgcatgtttttgcacgcctttgtgcgctggccccagagtcccatggatcgcaaccccaccatgaacttgctcaagggagtgcccaacgccatgctccagagcccccaggtccagcccaccctgcgccacaaccaggaacagctctaccgcttcctggagcgccactccccctacttccgcagtcacagcgcgcgcatccggggggccacctctttctgccacttgcaagaaaacatgcaagacggaaaatgatgtacagctcgctttttaataaatgtaaagactgtgcactttatttatacacgggctctttctggttatttattcaacaccgccgtcgccatctagaaatcgaaagggttctgccgcgcgtcgccgtgcgccacgggcagagacacgttgcgatactggaagcggctcgcccacttgaactcgggcaccaccatgcggggcagtggttcctcggggaagttctcgccccacagggtgcgggtcagctgcagcgcgctcaggaggtcgggagccgagatcttgaagtcgcagttggggccggaaccctgcgcgcgcgagttgcggtacacggggttgcagcactggaacaccagcagggccggattatgcacgctggccagcaggctctcgtcgctgatcatgtcgctgtccagatcctccgcgttgctcagggcgaatggggtcatcttgcagacctgcctgcccaggaaaggcggcagcccgggcttgccgttgcagtcgcagcgcaggggcatcagcaggtgcccgcggcccgactgcgcctgcgggtacagcgcgcgcatgaaggcttcgatctgcctgaaagccacctgcgccttggctccctccgaaaagaacatcccacaggacttgctggagaactggttcgcgggacagctggcatcgtgcaggcagcagcgcgcgtcggtgttggcgatctgcaccacgttgcgaccccaccggttcttcactatcttggccttggaagcctgctccttcagcgcgcgctggccgttctcgctggtcacatccatctctatcacctgctccttgttgatcatgtttgtcccgtgcagacacttcaggtcgccctccgtctgggtgcagcggtgctcccacagcgcgcaaccggtgggctcccaattcttgtgggtcacccccgcgtaggcctgcaggtaggcctgcaagaagcgccccatcatggccacgaaggtcttctggctcgtaaaggtcagctgcaggccgcgatgctcttcgttcagccaggtcttgcagatggcggccagcgcctcggtctgctcgggcagcatcctaaaatttgtcttcaggtcgttatccacgtggtacttgtccatcatggcgcgcgccgcctccatgcccttctcccaggcggacaccatgggcaggcttagggggtttatcacttccaccggcgaggacaccgtactttcgatttcttcttcctccccctcttcccggcgcgcgcccacgctgctgcgcgctctcaccgcctgcaccaaggggtcgtcttcaggcaagcgccgcaccgagcgcttgccgcccttgacctgcttaatcagcaccggcgggttgctgaagcccaccatggtcagcgccgcctgctcttcttcgtcttcgctgtctaccactatctctggggaagggcttctccgctctgcggcggtgcgcttcttttttttcttgggagcagccgtgacggagtccgccacggcgacggaggtcgagggcgtggggctgggggtgcgcggtaccagggcctcgtcgccctcggactcttcctctgactccaggcggcggcggagtcgcttctttgggggcgcgcgcgtcagcggcggcggagacggggacggggacggggacgggacgccctccacagggggtggtcttcgcgcagacccgcggccgcgctcgggggtcctctcgagctggtcttggtctcgactggccattgtatcctcctcctcctaggcagagagacataaggagtctatcatgcaagtcgagaaggaggagagcttaaccaccccctctgacaccgccgatgcgcccgccgtcgccgtcgcccccgctgccgccgacgcgcccgccacaccgagcgacacccccgcggacccccccgccgacgcacccctgttcgaggaagcggccgtggagcaggacccgggctttgtctcggcagaggaggatttgcgagaggaggagaataaggagaagaagccctcagtgccaaaagatgataaagagcaagacgagcacgacgcagatgcacaccagggtgaagtcgggcggggggacggagggcatggcggcgccgactacctagacgaagggaacgacgtgctcttgaagcacctgcatcgtcagtgcgccatcgtttgcgacgctctgcaggagcgcagcgaagtgcccctcagcgtggcggaggtcagccacgcctacgagctcagcctcttctccccccgggtgcccccccgccgccgcgaaaacggcacatgcgagcccaacccgcgcctcaacttctaccccgccttcgtggtgcccgaggtcctggccacctatcacatcttctttcaaaattgcaagatccccctctcgtgccgcgccaaccgtagccgcgccgataagatgctggccctgcgccagggcgaccacatacctgatatcgccgctttggaagatgtgccaaagatctttgagggtctgggtcgcaacgagaagcgggcagcaaactctctgcaacaggaaaacagcgaaaatgagagtcacaccggggtactggtggagctcgagggcgacaacgcccgcctggcggtggtcaagcgcagcatcgaggtcacccactttgcctaccccgcgctaaacctgccccccaaagtcatgaacgcggccatggacgggctgatcatgcgccgcggccggcccctcgctccagatgcaaacttgcatgaggagaccgaggacggccagcccgtggtcagcgacgagcagctggcgcgctggctggagaccgcggaccccgccgaactggaggagcggcgcaagatgatgatggccgcggtgctggtcaccgtagagctggagtgtctgcagcgcttcttcggcgaccccgagatgcagagaaaggtcgaggagaccctgcactacaccttccgccagggctacgtgcgccaggcttgcaagatctccaacgtggagctcagcaacctggtgtcctacctgggcatcttgcatgagaaccgcctcgggcagagcgtgctgcactccaccctgcgcggggaggcgcgccgcgactacgtgcgcgactgcgtttacctcttcctctgctacacctggcagacggccatgggggtctggcagcagtgtctggaggagcgcaacctcaaagagctggagaagctcctgcagcgcgcgctcaaagacctctggacgggctacaacgagcgctcggtggccgccgcgctggccgacctcatcttccccgagcgcctgctcaaaaccctccagcaggggctgcccgacttcaccagccaaagcatgttgcaaaacttcaggaactttatcctggagcgttctggcatcctacccgccacctgctgcgccctgcccagcgactttgtccccctcgtgtaccgcgagtgccccccgccgctgtggggtcactgctacctgttccaactggccaactacctgtcctaccacgcggacctcatggaggactccagcggcgaggggctcatggagtgccactgccgctgcaacctctgcacgccccaccgctccctggtctgcaacacccaactgctcagcgagagtcagattatcggtaccttcgagctacagggtccgtcctcctcagacgagaagtccgcggctccggggctaaaactcactccggggctgtggacttccgcctacctgcgcaaatttgtacctgaagactaccacgcccacgagatcaggttttacgaggaccaatcccgcccgcccaaggcggagctgaccgcctgcgtcatcacccagggcgagatcctaggccaattgcaagccatccaaaaagcccgccaagattttttgctgaagaagggtcggggggtgtatctggacccccagtcgggtgaggagctcaacccggttcccccgctgccgccgccgcgggaccttgcttcccaggataagcatcgccatggctcccagaaagaagcagcagcggccgccactgccgccaccccacatgctggaggaagaggaggaatactgggacagtcaggcagaggaggtttcggacgaggaggagccggagacggagatggaagagtgggaggaggacagcttagacgaggaggcttccgaagccgaagaggcagacgcaacaccgtcaccctcggccgcagccccctcgcaggcgcccccgaagtccgctcccagcatcagcagcaacagcagcgctataacctccgctcctccaccgccgcgacccacggccgaccgcagacccaaccgtagatgggacaccaccggaaccggggccggtaagtcctccgggagaggcaagcaagcgcagcgccaaggctaccgctcgtggcgcgctcacaagaacgccatagtcgcttgcttgcaagactgcggggggaacatctccttcgcccgccgcttcctgctcttccaccacggtgtggccttcccccgtaacgtcctgcattactaccgtcatctctacagcccctactgcggcggcagtgagccagagacggtcggcggcggcggcgcccgtttcggcgcctaggaagacccagggcaagacttcagccaagaaactcgcggcggccgcggcgaacgcggtcgcgggggccctgcgcctgacggtgaacgaacccctgtcgacccgcgaactgaggaaccgaatcttccccactctctatgccatcttccagcagagcagagggcaggatcaggaactgaaagtaaaaaacaggtctctgcgctccctcacccgcagctgtctgtatcacaagagcgaagaccagcttcggcgcacgctggaggacgctgaggcactcttcagcaaatactgcgcgctcactcttaaggactagctccgcgcccttctcgaatttaggcgggaacgcctacgtcatcgcagcgccgccgtcatgagcaaggacattcccacgccatacatgtggagctatcagccgcagatgggactcgcggcgggcgcctcccaagactactccacccgcatgaactggctcagtgccggcccacacatgatctcacaggttaatgatatccgcacccatcgaaaccaaatattggtggagcaggcggcgattaccaccacgccccgcaataatcccaaccccagggagtggcccgcgtccctggtgtatcaggaaattcccggccccaccaccgtactacttccgcgtgattcccaggccgaagtccaaatgactaactcaggggcgcagctcgcgggcggctgtcgtcacagggtgcggccccctcgccagggtataactcacctggagatccgaggcagaggtattcagctcaacgacgagtcggtgagctcctcgctcggtctcagacctgacgggaccttccagatagccggagccggccgatcttccttcacgccccgccaggcgtacctgactctgcagagctcgtcctcggcgccgcgctcgggcggcatcgggactctccagttcgtgcaggagtttgtgccctcggtctacttcaaccccttctccggctctcccggtcgctacccggaccagttcatctcgaactttgacgccgcgagggactcggtggacggctacgactgaatgtcgggtggacccggtgcagagcaacttcgcctgaagcacctcgaccactgccgccgccctcagtgctttgcccgctgtcagaccggtgagttccagtacttttccctgcccgactcgcacccggacggcccggcgcacggggtgcgctttttcatcccgagtcaggtgcgctctaccctaatcagggagtttaccgcccgtcccctactggcggagttggaaaaggggccttctatcctaaccattgcctgcatctgctctaaccctggattgcaccaagatctttgctgtcatttgtgtgctgagtataataaaggctgagatcagaatctactcgggctcctgtcgccatcctgtcaacgccaccgtccaagcccggcccgatcagcccgaggtgaacctcacctgcggtctgcaccggcgcctgagaaaatacctagcttggtactacaacagcactccctttgtggtttacaacagctttgaccaggacggggtctcactgagggataacctctcgaacctgagctactccatcaggaagaacagcaccctcgagctacttcctccttacctgcccgggacttaccagtgtgtcaccggtccctgcacccacacccacctgttgatcgtaaacgactctcttccgagaacagacctcaataactcctcttcgcagttccccagaacaggaggtgagctcaggaaaccccgggtaaagaagggtggacaagagttaacacttgtggggtttctggtgtatgtgacgctggtggtggctcttttgattaaggcttttccttccatgtctgaactctccctcttcttttatgaacaactcgactagtgctaacgggaccctacccaacgaatcgggattgaatatcggtaaccaggttgcagtttcacttttgattaccttcatagtcctcttcctgctagtgctgtcgcttctgtgcctgcggatcgggggctgctgcatccacgtttatatctggtgctggctgtttagaaggttcggagaccatcgcaggtagaataaacatgctgctgcttaccctctttgtcctggcgctggccgccagctgccaagccttttccgaggctgattttatagaaccccagtgcaatatcacttataaatctgaatataacctctgcactatcctaattaaatgcgttactcaacacgatgaggtaactgttagatacaaagatcaatcaaaaagagacgcactttacagcagctggcaaccaggagatgaacaaaaatacaatgtgaccgtcttccagggcaaactctccaaaacttacaattacactttcccattcgaggagatgtgtgagtttgtcatgttcatgtcaaagcagtacaagatgtggcctccgactccccagggctgtgtggaaaatccaggctctttctgcatgatctctctctgtgtaactgtgctggcactaatactcacgcttttgtatatcagatttaaatcaaggcaaagcttcatcgatgaaaagaaaatgccttaatcgcttttcacgcttgattgctaacaccgggtttttatccgcagaatgattggaatcaccctactaatcacctccctccttgcgattgcccatgggttggaacgaatcgaagtccctgtgggggccaatgttaccctggtggggcctgtcggcaatgctacattaatgtgggaaaaatatactaaaaatcaatgggtctcttactgcactaacaaaaacagccacaagcccagagccatctgcgatgggcaaaatttaaccttgattgatgttcaattgctggatgcgggctactattatgggcagctgggtacaatcgttaattactggagaccccacaaagattacatgcttcacgtagtaaagggtccccttagcagcccgaccactaccaccacctctaccacacccactaccaccactactcccatcaccagcactgccacccagcctcctcatagcagaacaaccacttttatcaattccaagtcccactccccccacattgccggcgggccctccgcctcaaactccgagaccaccgagatctgcttctgcaaatgctctgacgccattgcccaggatttggaagaccacgaggaagatgagcatgacttcgcagatgcatgccaggcatcaggggcagaagcactgccggtggccctcaaacagtatgcagactcccataccacccccgatcttccaccgccttcccagaagccaagtttcctgggggaaaatgaaacactgcctctctccatacttgctttgacatctgttgctattctgactgctctgctggtgctcctatgctctatatgctacctgatctgctgcaggaagaaaaaatctcacggccatgctcaccagccgcttatgcacttcccttaccctccagagttgggcgaccacaaactttaagtctgcagtagctatctgcccatcccttgtcagtcgacagcgatgagccccactaatctaacggcctctggacttacaacattgtctcttaatgagaccaccgctcctcaagacctgtacgatggtgtctccgcgctggttaaccagtgggatcacctgggcatatggtggctcctcataggagcagtgaccctgtgcctaatcctggtctggataatctgctgcatcaaaagcagaagacccaggcggcggcccatctacaggcccttcgtcatcacacctgaagatgatgatggcaccacgtccaggctgcagagcctaaagcagctactcttctcttttacagcatggtaaattgaacatgcctcgcattttcatctacttgtttcttcttccactctttttgggctcttctacattggcagctgtgtcccacatcgaggtagactgcatctcgcccttctcagtctacttactcttcggctttgtcatttgcaactttgtctgcagcgttatcactgtagtgatctgcttcatacagtgcatcgactacgtctgcgtacgggtggcctattttagacaccacccccagtatcgcaacagggacatagcggctctcctaagacttgtttaaatcatgcccaaattaactgtgattgctcttctgattatctgctgcgtcctagccgcgattgggactcagcctactaccaccaccaccagcgctcccagaaagagacatgtttcctgcagcttcaaacgtccctggaatataccccaatgctttactgatgaacctgaaatctctttggcttggtacttcagcgtcaccgcccttctcatcttctgcagtacggttattgcccttgccatttacccttcccttgacctgggctggaatgctgtcaactctatggaatatcccaccttcccagaaccagacctgccagacctggttgttctaaacgcgtttcctcctcctcccgttcaaaatcagtttcgccctccgtccccgacgcccactgaggtcagctactttaatctaacaggcggagatgactgaaaacctagacctagaaatggacggcctctgcagcgaacaacgcatactagagaggcgccggcaaaaagcagagctcgagcgtcttaaacaagagctccaagacgcggtggccatacaccagtgcaaaaaaggtgtcttctgtctagtgaaacaggccacgctcacctatgaaaaaacaggtgacacccaccgcctaggatacaagctgcccacacaacgccagaagttcgcccttatgataggcgaacaacccatcaccgtcacccagcactctgtggagacagaaggctgcatacacgctccctgcaggggcgctgactgtctctacaccttgatcaaaaccctctgcggccttagagacctcatccctttcaattgatcataactgtaatcaataaaaaatcacttacttgaaatctgatagcaagcctctgtccaattttttcagcaacacttccttcccctcctcccaactctggtactctaggcgcctcctagctgcaaacttcctccacagtctgaagggaatgtcagattcctcctcctgtccctccgcacccacgatcttcatgttgttgcagatgaaacgcgcgagatcgtctgacgagaccttcaaccccgtgtacccctacgataccgagatcgctccgacttctgtcccttttcccacccctccctttgtgtcccccgcaggaatgcaagaaaacccccctggagtgctatccctacgccttgcagaacccttgaccacctccaatggagcgctgaccctaaaaatggggggtggtttgaccctggacgaagaaggaaagcttacttcccaaaatattaccagtgttgatcctcctcttaaaaaaacaaaaaacaatatcagtctgcagactgcctccccccttgccgtcagctcgggagccctcacacttttcgctactcctcccctggcagttaatgacaataacctaactgtgcagtctcaggctccccttacactggaaaactcaaaactaagtctggccaccaaaggccccctaaccgtttctgaaggaaaacttgccctagaaacagaggctcccttgcatgcaagcgacagcagtagcctaggccttagtgtaacggccccactgagcattagcagcgacagcctaggactagacttgcaagcgcccattatttctgaaaatggaaaactgggcctaagagtaacaggtcccctaactgtggccagcagtattgatgctttgacagtagccacaggcagcggtattggacttgatagcaacacgcgcctacaggcaaaattggtcgcgcccctaggctttgacaccaatggcaacattaagctcagcacttcgggcggcatgagactgaacaatggcacacttatactagatgtaaactacccatttgaggctcaaggtcaacttagtctaagagtgggttcgggtccactgtatgtagactccaacacacataacctaaccgctagatgccttagagggctatacataacgtcatctaataaccaaaccggcctggaggccaacataaaacttacaaaaggacttgtgtttgatggaaatgccatagcagttaatgttagcaaagggctagaatacagtaccactgaaacagcgcagggtgtaaatcccatacagactaaaataggtttgggcatggaatatgataccaatggagccataaagccaagactaggctctggtttgagctttgataattcaggagctattgtagtgggaaacaaaaatgatgacactcttactctgtggactacaccagacccatctcccaactgtcagattaactcggaaaaagatgctaaactaaccttggtactaaccaagtgcggtagtcaaattgtaggcacagtatctgcctttgctcttaaaggcagccttgccccaattaatggcacagtgagctcagttagtatattcctaagatttaatgaaaatggggtactgatgagcaactcatcgttggaaagccaatactggaattacaggaatggaaattcaactaatgccacaccatatacaaatgcactaggttttatgcctaacctggcagcttatcccaaaggccaggcaacgactgcaaaaagcagcatcattagccaggtttacatgaatggtgacacttccaaacctatgatatttacaataacttttaatgggcttgaaacagaggaaactcaggtcagtacatattccatgacattttcatggaggtggacaaatggagactacgtggggcactattttaaaacaaactcctttactttctcctacattgcccaagaataaagaaagcacagagatgcttgtttttgatttcaaaattgtgtgcttttatttatttcaagcttacagtatttccagtagtcattcgaatagagcttaattaaactgcatgagaacccttccacatagcttaaattagcaccagtgcaaatggagaaaagctctagagcgcggccgggatcggtgatcaccgatccagacatgataagatacattgatgagtttggacaaaccacaactagaatgcagtgaaaaaaatgctttatttgtgaaatttgtgatgctattgctttatttgtaaccattataagctgcaataaacaagttcccggatcgcgatccggcccgaggctgtagccgacgatggtgcgccaggagagttgttgattcattgtttgcctccctgctgcggtttttcaccgaagttcatgccagtccagcgtttttgcagcagaaaagccgccgacttcggtttgcggtcgcgagtgaagatccctttcttgttaccgccaacgcgcaatatgccttgcgaggtcgcaaaatcggcgaaattccatacctgttcaccgacgacggcgctgacgcgatcaaagacgcggtgatacatatccagccatgcacactgatactcttcactccacatgtcggtgtacattgagtgcagcccggctaacgtatccacgccgtattcggtgatgataatcggctgatgcagtttctcctgccaggccagaagttctttttccagtaccttctctgccgtttccaaatcgccgctttggacataccatccgtaataacggttcaggcacagcacatcaaagagatcgctgatggtatcggtgtgagcgtcgcagaacattacattgacgcaggtgatcggacgcgtcgggtcgagtttacgcgttgcttccgccagtggcgcgaaatattcccgtgcaccttgcggacgggtatccggttcgttggcaatactccacatcaccacgcttgggtggtttttgtcacgcgctatcagctctttaatcgcctgtaagtgcgcttgctgagtttccccgttgactgcctcttcgctgtacagttctttcggcttgttgcccgcttcgaaaccaatgcctaaagagaggttaaagccgacagcagcagtttcatcaatcaccacgatgccatgttcatctgcccagtcgagcatctcttcagcgtaagggtaatgcgaggtacggtaggagttggccccaatccagtccattaatgcgtggtcgtgcaccatcagcacgttatcgaatcctttgccacgcaagtccgcatcttcatgacgaccaaagccagtaaagtagaacggtttgtggttaatcaggaactgttcgcccttcactgccactgaccggatgccgacgcgaagcgggtagatatcacactctgtctggcttttggctgtgacgcacagttcatagagataaccttcacccggttgccagaggtgcggattcaccacttgcaaagtcccgctagtgccttgtccagttgcaaccacctgttgatccgcatcacgcagttcaacgctgacatcaccattggccaccacctgccagtcaacagacgcgtggttacagtcttgcgcgacatgcgtcaccacggtgatatcgtccacccaggtgttcggcgtggtgtagagcattacgctgcgatggattccggcatagttaaagaaatcatggaagtaagactgctttttcttgccgttttcgtcggtaatcaccattcccggcgggatagtctgccagttcagttcgttgttcacacaaacggtgatacgtacacttttcccggcaataacatacggcgtgacatcggcttcaaatggcgtatagccgccctgatgctccatcacttcctgattattgacccacactttgccgtaatgagtgaccgcatcgaaacgcagcacgatacgctggcctgcccaacctttcggtataaagacttcgcgctgataccagacgttgcccgcataattacgaatatctgcatcggcgaactgatcgttaaaactgcctggcacagcaattgcccggctttcttgtaacgcgctttcccaccaacgctgatcaattccacagttttcgcgatccagactgaatgcccacaggccgtcgagttttttgatttcacgggttggggtttctacaggacggaccatgcgttcgacctttctcttcttttttgggcccatgatggcagatccgtatagtgagtcgtattagctggttctttccgcctcagaagccatagagcccaccgcatccccagcatgcctgctattgtcttcccaatcctcccccttgctgtcctgccccaccccaccccccagaatagaatgacacctactcagacaatgcgatgcaatttcctcattttattaggaaaggacagtgggagtggcaccttccagggtcaaggaaggcacgggggaggggcaaacaacagatggctggcaactagaaggcacagtcgaggctgatcagcgagctctagatgcatgctcgagcggccgcacgtcggagtataccggggtaccccgacgccgcgtaactataacggtcctaaggtagcgaaaaagggccaagtgccgaacgagtatatataggaataaaaaatgacgtaaatgtgtaaaggtcagaaaacgcccagaaaaatacacagaccaacgcccgaaacgaaaacccgcgaaaaaatacccagaacttcctcaacaaccgccacttccgctttctcacgatacgtcacttccgcaagaaaagcaaaactacatttcccacatgtgtaaaaacgaaaccccgccccttctaaccgcccacaacttacatcatcaaaacgtaaagtcctacgtcacccgccccgcctctccccgcccacctcattatcatattggccacaatccaaaataaggtatattattgatgatg

The invention claimed is:

1. An adenovirus or adenoviral vector comprising a non-native nucleic acid sequence, a nucleic acid sequence that is at least 96% identical to SEQ ID NO: 1, and one or more of the nucleic acid sequences selected from the group consisting of:
   (a) a nucleic acid sequence that is at least 99% identical to SEQ ID NO: 2,
   (b) a nucleic acid sequence that is at least 80% identical to SEQ ID NO: 3,
   (c) a nucleic acid sequence that is at least 80% identical to SEQ ID NO: 4, and
   (d) a nucleic acid sequence that is at least 85.4% identical to SEQ ID NO: 5.

2. The adenovirus or adenoviral vector of claim 1, which comprises the nucleic acid sequence of SEQ ID NO: 1.

3. The adenovirus or adenoviral vector of claim 1, which comprises a nucleic acid sequence that is at least 99% identical to SEQ ID NO: 2.

4. The adenovirus or adenoviral vector of claim 3, which comprises the nucleic acid sequence of SEQ ID NO: 2.

5. The adenovirus or adenoviral vector of claim 1, which comprises a nucleic acid sequence that is at least 80% identical to SEQ ID NO: 3.

6. The adenovirus or adenoviral vector of any one of claim 5, which comprises the nucleic acid sequence of SEQ ID NO: 3.

7. The adenovirus or adenoviral vector of claim 1, which comprises a nucleic acid sequence that is at least 80% identical to SEQ ID NO: 4.

8. The adenovirus or adenoviral vector of claim 7, which comprises the nucleic acid sequence of SEQ ID NO: 4.

9. The adenovirus or adenoviral vector of claim 1, which comprises a nucleic acid sequence that is at least 85.4% identical to SEQ ID NO: 5.

10. The adenovirus or adenoviral vector of claim 9, which comprises the nucleic acid sequence of SEQ ID NO: 5.

11. An adenovirus or adenoviral vector comprising a non-native nucleic acid sequence and one or more of the nucleic acid sequences selected from the group consisting of:
    (a) a nucleic acid sequence that is at least 98.7% identical to SEQ ID NO: 6,
    (b) a nucleic acid sequence that is at least 98.9% identical to SEQ ID NO: 7,
    (c) a nucleic acid sequence that is at least 99.4% identical to SEQ ID NO: 8,
    (d) a nucleic acid sequence that is at least 99.1% identical to SEQ ID NO: 9,
    (e) a nucleic acid sequence that is at least 81.25% identical to SEQ ID NO: 10,
    (f) a nucleic acid sequence that is at least 90.83% identical to SEQ ID NO: 11, and
    (g) a nucleic acid sequence that is at least 82.5% identical to SEQ ID NO: 12.

12. The adenovirus or adenoviral vector of claim 11, which comprises a nucleic acid sequence that is at least 98.7% identical to SEQ ID NO: 6.

13. The adenovirus or adenoviral vector of claim 12, which comprises the nucleic acid sequence of SEQ ID NO: 6.

14. The adenovirus or adenoviral vector of claim 11, which comprises a nucleic acid sequence that is at least 98.9% identical to SEQ ID NO: 7.

15. The adenovirus or adenoviral vector of claim 14, which comprises the nucleic acid sequence of SEQ ID NO: 7.

16. The adenovirus or adenoviral vector of claim 11, which comprises a nucleic acid sequence that is at least 99.4% identical to SEQ ID NO: 8.

17. The adenovirus or adenoviral vector of claim 16, which comprises the nucleic acid sequence of SEQ ID NO: 8.

18. The adenovirus or adenoviral vector of claim 11, which comprises a nucleic acid sequence that is at least 99.1% identical to SEQ ID NO: 9.

19. The adenovirus or adenoviral vector of claim 18, which comprises the nucleic acid sequence of SEQ ID NO: 9.

20. The adenovirus or adenoviral vector of claim 11, which comprises a nucleic acid sequence that is at least 81.25% identical to SEQ ID NO: 10.

21. The adenovirus or adenoviral vector of claim 20, which comprises the nucleic acid sequence of SEQ ID NO: 10.

22. The adenovirus or adenoviral vector of claim 11, which comprises a nucleic acid sequence that is at least 90.83% identical to SEQ ID NO: 11.

23. The adenovirus or adenoviral vector of claim 22, which comprises the nucleic acid sequence of SEQ ID NO: 11.

24. The adenovirus or adenoviral vector of claim 11, which comprises a nucleic acid sequence that is at least 82.5% identical to SEQ ID NO: 12.

25. The adenovirus or adenoviral vector of claim 24, which comprises the nucleic acid sequence of SEQ ID NO: 12.

26. An adenovirus or adenoviral vector comprising a non-native nucleic acid sequence and one or more of the nucleic acid sequences selected from the group consisting of:
    (a) a nucleic acid sequence comprising at least 162 contiguous nucleotides of SEQ ID NO: 6,
    (b) a nucleic acid sequence comprising at least 162 contiguous nucleotides of SEQ ID NO: 7,
    (c) a nucleic acid sequence comprising at least 121 contiguous nucleotides of SEQ ID NO: 8,
    (d) a nucleic acid sequence comprising at least 531 contiguous nucleotides of SEQ ID NO: 9,
    (e) a nucleic acid sequence comprising at least 156 contiguous nucleotides of SEQ ID NO: 10,
    (f) a nucleic acid sequence comprising at least 192 contiguous nucleotides of SEQ ID NO: 11, and
    (g) a nucleic acid sequence comprising at least 84 contiguous nucleotides of SEQ ID NO: 12.

27. The adenovirus or adenoviral vector of claim 26, which comprises a nucleic acid sequence comprising at least 162 contiguous nucleotides of SEQ ID NO: 6.

28. The adenovirus or adenoviral vector of claim 27, which comprises the nucleic acid sequence of SEQ ID NO: 6.

29. The adenovirus or adenoviral vector of claim 26, which comprises a nucleic acid sequence comprising at least 162 contiguous nucleotides of SEQ ID NO: 7.

30. The adenovirus or adenoviral vector of claim 29, which comprises the nucleic acid sequence of SEQ ID NO: 7.

31. The adenovirus or adenoviral vector of claim 26, which comprises a nucleic acid sequence comprising at least 121 contiguous nucleotides of SEQ ID NO: 8.

32. The adenovirus or adenoviral vector of claim 31, which comprises the nucleic acid sequence of SEQ ID NO: 8.

33. The adenovirus or adenoviral vector of claim 26, which comprises a nucleic acid sequence comprising at least 531 contiguous nucleotides of SEQ ID NO: 9.

34. The adenovirus or adenoviral vector of claim 33, which comprises the nucleic acid sequence of SEQ ID NO: 9.

35. The adenovirus or adenoviral vector of claim 26, which comprises a nucleic acid sequence comprising at least 156 contiguous nucleotides of SEQ ID NO: 10.

36. The adenovirus or adenoviral vector of claim 35, which comprises the nucleic acid sequence of SEQ ID NO: 10.

37. The adenovirus or adenoviral vector of claim 26, which comprises a nucleic acid sequence comprising at least 192 contiguous nucleotides of SEQ ID NO: 11.

38. The adenovirus or adenoviral vector of claim 37, which comprises the nucleic acid sequence of SEQ ID NO: 11.

39. The adenovirus or adenoviral vector of claim 26, which comprises a nucleic acid sequence comprising at least 84 contiguous nucleotides of SEQ ID NO: 12.

40. The adenovirus or adenoviral vector of claim 39, which comprises the nucleic acid sequence of SEQ ID NO: 12.

41. An adenovirus or adenoviral vector comprising a non-native nucleic acid sequence and one or more of the amino acid sequences selected from the group consisting of:
   (a) an amino acid sequence that is at least 85% identical to SEQ ID NO: 14,
   (b) an amino acid sequence that is at least 80% identical to SEQ ID NO: 15, and
   (c) an amino acid sequence that is at least 80% identical to SEQ ID NO: 16.

42. The adenovirus or adenoviral vector of claim 41, which comprises an amino acid sequence that is at least 85% identical to SEQ ID NO: 14.

43. The adenovirus or adenoviral vector of claim 42, which comprises the amino acid sequence of SEQ ID NO: 14.

44. The adenovirus or adenoviral vector of claim 41, which comprises an amino acid sequence that is at least 80% identical to SEQ ID NO: 15.

45. The adenovirus or adenoviral vector of claim 44, which comprises the amino acid sequence of SEQ ID NO: 15.

46. The adenovirus or adenoviral vector of claim 41, which comprises an amino acid sequence that is at least 80% identical to SEQ ID NO: 16.

47. The adenovirus or adenoviral vector of claim 46, which comprises the amino acid sequence of SEQ ID NO: 16.

48. An adenovirus or adenoviral vector comprising a non-native nucleic acid sequence and one or more of the nucleic acid sequences selected from the group consisting of:
   (a) a nucleic acid sequence encoding an amino acid sequence that is at least 99.7% identical to SEQ ID NO: 13,
   (b) a nucleic acid sequence encoding an amino acid sequence that is at least 85% identical to SEQ ID NO: 14,
   (c) a nucleic acid sequence encoding an amino acid sequence that is at least 80% identical to SEQ ID NO: 15, and
   (d) a nucleic acid sequence encoding an amino acid sequence that is at least 80% identical to SEQ ID NO: 16.

49. The adenovirus or adenoviral vector of claim 48, which comprises a nucleic acid sequence encoding an amino acid sequence that is at least 99.7% identical to SEQ ID NO: 13.

50. The adenovirus or adenoviral vector of claim 49, which comprises a nucleic acid sequence encoding the amino acid sequence of SEQ ID NO: 13.

51. The adenovirus or adenoviral vector of claim 48, which comprises a nucleic acid sequence encoding an amino acid sequence that is at least 85% identical to SEQ ID NO: 14.

52. The adenovirus or adenoviral vector of claim 51, which comprises a nucleic acid sequence encoding the amino acid sequence of SEQ ID NO: 14.

53. The adenovirus or adenoviral vector of claim 48, which comprises a nucleic acid sequence encoding an amino acid sequence that is at least 80% identical to SEQ ID NO: 15.

54. The adenovirus or adenoviral vector of claim 53, which comprises a nucleic acid sequence encoding the amino acid sequence of SEQ ID NO: 15.

55. The adenovirus or adenoviral vector of claim 48, which comprises a nucleic acid sequence encoding an amino acid sequence that is at least 80% identical to SEQ ID NO: 16.

56. The adenovirus or adenoviral vector of claim 55, which comprises a nucleic acid sequence encoding the amino acid sequence of SEQ ID NO: 16.

57. An adenovirus or adenoviral vector comprising a non-native nucleic acid sequence and one or more of the amino acid sequences selected from the group consisting of:
   (a) an amino acid sequence that is at least 99% identical to SEQ ID NO: 18,
   (b) an amino acid sequence that is at least 81.4% identical to SEQ ID NO: 20,
   (c) an amino acid sequence that is at least 91.3% identical to SEQ ID NO: 21, and
   (d) an amino acid sequence that is at least 83.4% identical to SEQ ID NO: 22.

58. The adenovirus or adenoviral vector of claim 57, which comprises an amino acid sequence that is at least 99% identical to SEQ ID NO: 18.

59. The adenovirus or adenoviral vector of claim 58, which comprises the amino acid sequence of SEQ ID NO: 18.

60. The adenovirus or adenoviral vector of claim 57, which comprises an amino acid sequence that is at least 81.4% identical to SEQ ID NO: 20.

61. The adenovirus or adenoviral vector of claim 60, which comprises the amino acid sequence of SEQ ID NO: 20.

62. The adenovirus or adenoviral vector of claim 57, which comprises an amino acid sequence that is at least 91.3% identical to SEQ ID NO: 21.

63. The adenovirus or adenoviral vector of claim 62, which comprises the amino acid sequence of SEQ ID NO: 21.

64. The adenovirus or adenoviral vector of claim 57, which comprises an amino acid sequence that is at least 83.4% identical to SEQ ID NO: 22.

65. The adenovirus or adenoviral vector of claim 64, which comprises the amino acid sequence of SEQ ID NO: 22.

66. An adenovirus or adenoviral vector comprising a non-native nucleic acid sequence and one or more of the nucleic acid sequences selected from the group consisting of:

(a) a nucleic acid sequence encoding an amino acid sequence that is at least 99% identical to SEQ ID NO: 18,
(b) a nucleic acid sequence encoding an amino acid sequence that is at least 99.75% identical to SEQ ID NO: 19,
(c) a nucleic acid sequence encoding an amino acid sequence that is at least 81.4% identical to SEQ ID NO: 20,
(d) a nucleic acid sequence encoding an amino acid sequence that is at least 91.3% identical to SEQ ID NO: 21,
(e) a nucleic acid sequence encoding an amino acid sequence that is at least 83.4% identical to SEQ ID NO: 22.

67. The adenovirus or adenoviral vector of claim 66, which comprises a nucleic acid sequence encoding an amino acid sequence that is at least 99% identical to SEQ ID NO: 18.

68. The adenovirus or adenoviral vector of claim 67, which comprises a nucleic acid sequence encoding the amino acid sequence of SEQ ID NO: 18.

69. The adenovirus or adenoviral vector of claim 66, which comprises a nucleic acid sequence encoding an amino acid sequence that is at least 99.75% identical to SEQ ID NO: 19.

70. The adenovirus or adenoviral vector of claim 69, which comprises a nucleic acid sequence encoding the amino acid sequence of SEQ ID NO: 19.

71. The adenovirus or adenoviral vector of claim 66, which comprises a nucleic acid sequence encoding an amino acid sequence that is at least 81.4% identical to SEQ ID NO: 20.

72. The adenovirus or adenoviral vector of claim 71, which comprises a nucleic acid sequence encoding the amino acid sequence of SEQ ID NO: 20.

73. The adenovirus or adenoviral vector of claim 66, which comprises a nucleic acid sequence encoding an amino acid sequence that is at least 91.3% identical to SEQ ID NO: 21.

74. The adenovirus or adenoviral vector of claim 73, which comprises a nucleic acid sequence encoding the amino acid sequence of SEQ ID NO: 21.

75. The adenovirus or adenoviral vector of claim 66, which comprises a nucleic acid sequence encoding an amino acid sequence that is at least 83.4% identical to SEQ ID NO: 22.

76. The adenovirus or adenoviral vector of claim 75, which comprises a nucleic acid sequence encoding the amino acid sequence of SEQ ID NO: 22.

77. An adenovirus or adenoviral vector comprising a non-native nucleic acid sequence and one or more of the amino acid sequences selected from the group consisting of:
(a) an amino acid sequence comprising at least 89 contiguous amino acid residues of SEQ ID NO: 18,
(b) an amino acid sequence comprising at least 114 contiguous amino acid residues of SEQ ID NO: 20,
(c) an amino acid sequence comprising at least 231 contiguous amino acid residues of SEQ ID NO: 21, and
(d) an amino acid sequence comprising at least 30 contiguous amino acid residues of SEQ ID NO: 22.

78. The adenovirus or adenoviral vector of claim 77, which comprises an amino acid sequence comprising at least 89 contiguous amino acid residues of SEQ ID NO: 18.

79. The adenovirus or adenoviral vector of claim 78, which comprises the amino acid sequence of SEQ ID NO: 18.

80. The adenovirus or adenoviral vector of claim 77, which comprises an amino acid sequence comprising at least 114 contiguous amino acid residues of SEQ ID NO: 20.

81. The adenovirus or adenoviral vector of claim 80, which comprises the amino acid sequence of SEQ ID NO: 20.

82. The adenovirus or adenoviral vector of claim 77, which comprises an amino acid sequence comprising at least 231 contiguous amino acid residues of SEQ ID NO: 21.

83. The adenovirus or adenoviral vector of claim 82, which comprises the amino acid sequence of SEQ ID NO: 21.

84. The adenovirus or adenoviral vector of claim 77, which comprises an amino acid sequence comprising at least 30 contiguous amino acid residues of SEQ ID NO: 22.

85. The adenovirus or adenoviral vector of claim 84, which comprises the amino acid sequence of SEQ ID NO: 22.

86. An adenovirus or adenoviral vector comprising a non-native nucleic acid sequence and one or more of the nucleic acid sequences selected from the group consisting of:
(a) a nucleic acid sequence encoding an amino acid sequence comprising at least 89 contiguous amino acid residues of SEQ ID NO: 18,
(b) a nucleic acid sequence encoding an amino acid sequence comprising at least 428 contiguous amino acid residues of SEQ ID NO: 19,
(c) a nucleic acid sequence encoding an amino acid sequence comprising at least 114 contiguous amino acid residues of SEQ ID NO: 20,
(d) a nucleic acid sequence encoding an amino acid sequence comprising at least 231 contiguous amino acid residues of SEQ ID NO: 21, and
(e) a nucleic acid sequence encoding an amino acid sequence comprising at least 30 contiguous amino acid residues of SEQ ID NO: 22.

87. The adenovirus or adenoviral vector of claim 86, which comprises a nucleic acid sequence encoding an amino acid sequence comprising at least 89 contiguous amino acid residues of SEQ ID NO: 18.

88. The adenovirus or adenoviral vector of claim 87, which comprises a nucleic acid sequence encoding the amino acid sequence of SEQ ID NO: 18.

89. The adenovirus or adenoviral vector of claim 86, which comprises a nucleic acid sequence encoding an amino acid sequence comprising at least 428 contiguous amino acid residues of SEQ ID NO: 19.

90. The adenovirus or adenoviral vector of claim 89, which comprises a nucleic acid sequence encoding the amino acid sequence of SEQ ID NO: 19.

91. The adenovirus or adenoviral vector of claim 86, which comprises a nucleic acid sequence encoding an amino acid sequence comprising at least 114 contiguous amino acid residues of SEQ ID NO: 20.

92. The adenovirus or adenoviral vector of claim 91, which comprises a nucleic acid sequence encoding the amino acid sequence of SEQ ID NO: 20.

93. The adenovirus or adenoviral vector of claim 86, which comprises a nucleic acid sequence encoding an amino acid sequence comprising at least 231 contiguous amino acid residues of SEQ ID NO: 21.

94. The adenovirus or adenoviral vector of claim 93, which comprises a nucleic acid sequence encoding the amino acid sequence of SEQ ID NO: 21.

95. The adenovirus or adenoviral vector of claim 86, which comprises a nucleic acid sequence encoding an amino acid sequence comprising at least 30 contiguous amino acid residues of SEQ ID NO: 22.

96. The adenovirus or adenoviral vector of claim 95, which comprises a nucleic acid sequence encoding the amino acid sequence of SEQ ID NO: 22.

97. The adenovirus or adenoviral vector of claim 1, wherein the adenovirus or adenoviral vector requires complementation of a deficiency in one or more early regions of the adenoviral genome for propagation and does not require complementation of any other deficiency of the adenoviral genome for propagation.

98. The adenovirus or adenoviral vector of claim 1, wherein the non-native nucleic acid sequence is a transgene.

99. A composition comprising the adenovirus or adenoviral vector of claim 1 and a pharmaceutically acceptable carrier.

100. The adenovirus or adenoviral vector of claim 11, wherein the adenovirus or adenoviral vector requires complementation of a deficiency in one or more early regions of the adenoviral genome for propagation and does not require complementation of any other deficiency of the adenoviral genome for propagation.

101. The adenovirus or adenoviral vector of claim 41, wherein the adenovirus or adenoviral vector requires complementation of a deficiency in one or more early regions of the adenoviral genome for propagation and does not require complementation of any other deficiency of the adenoviral genome for propagation.

102. The adenovirus or adenoviral vector of claim 48, wherein the adenovirus or adenoviral vector requires complementation of a deficiency in one or more early regions of the adenoviral genome for propagation and does not require complementation of any other deficiency of the adenoviral genome for propagation.

103. The adenovirus or adenoviral vector of claim 11, wherein the non-native nucleic acid sequence is a transgene.

104. The adenovirus or adenoviral vector of claim 41, further comprising a transgene.

105. The adenovirus or adenoviral vector of claim 48, further comprising a transgene.

106. A composition comprising the adenovirus or adenoviral vector of claim 11 and a pharmaceutically acceptable carrier.

107. A composition comprising the adenovirus or adenoviral vector of claim 41 and a pharmaceutically acceptable carrier.

108. A composition comprising the adenovirus or adenoviral vector of claim 48 and a pharmaceutically acceptable carrier.

109. The adenovirus or adenoviral vector of claim 1, wherein the non-native nucleic acid sequence is naturally found in an adenovirus but located at a non-native position within the adenoviral genome.

110. The adenovirus or adenoviral vector of claim 11, wherein the non-native nucleic acid sequence is naturally found in an adenovirus but located at a non-native position within the adenoviral genome.

111. The adenovirus or adenoviral vector of claim 26, wherein the non-native nucleic acid sequence is a transgene or a nucleic acid sequence naturally found in an adenovirus but located at a non-native position within the adenoviral genome.

112. The adenovirus or adenoviral vector of claim 57, wherein the non-native nucleic acid sequence is a transgene or a nucleic acid sequence naturally found in an adenovirus but located at a non-native position within the adenoviral genome.

113. The adenovirus or adenoviral vector of claim 66, wherein the non-native nucleic acid sequence is a transgene or a nucleic acid sequence naturally found in an adenovirus but located at a non-native position within the adenoviral genome.

114. The adenovirus or adenoviral vector of claim 77, wherein the non-native nucleic acid sequence is a transgene or a nucleic acid sequence naturally found in an adenovirus but located at a non-native position within the adenoviral genome.

115. The adenovirus or adenoviral vector of claim 86, wherein the non-native nucleic acid sequence is a transgene or a nucleic acid sequence naturally found in an adenovirus but located at a non-native position within the adenoviral genome.

\* \* \* \* \*